United States Patent
Pennell et al.

(10) Patent No.: US 10,480,000 B2
(45) Date of Patent: Nov. 19, 2019

(54) METHODS OF INCREASING CROP YIELD UNDER ABIOTIC STRESS

(71) Applicant: CERES, INC., Thousand Oaks, CA (US)

(72) Inventors: Roger I. Pennell, Malibu, CA (US); Wuyi Wang, Newbury Park, CA (US); Chuan-Yin Wu, Newbury Park, CA (US); Dwarkesh Parihar, Hyderabad (IN); Paresh Verma, Hyderabad (IN); Vijay R. Kumar, Hyderabad (IN); Shridhar J. Rao, Hyderabad (IN)

(73) Assignee: CERES, INC., Thousand Oaks, CA (US)

( * ) Notice: Subject to any disclaimer, the term of this patent is extended or adjusted under 35 U.S.C. 154(b) by 67 days.

(21) Appl. No.: 15/326,437

(22) PCT Filed: Jul. 15, 2015

(86) PCT No.: PCT/US2015/040614
§ 371 (c)(1),
(2) Date: Jan. 13, 2017

(87) PCT Pub. No.: WO2016/011179
PCT Pub. Date: Jan. 21, 2016

(65) Prior Publication Data
US 2018/0282744 A1 Oct. 4, 2018

Related U.S. Application Data

(60) Provisional application No. 62/024,791, filed on Jul. 15, 2014.

(51) Int. Cl.
*C12N 15/82* (2006.01)

(52) U.S. Cl.
CPC ..... *C12N 15/8222* (2013.01); *C12N 15/8201* (2013.01); *C12N 15/8271* (2013.01); *C12N 15/8273* (2013.01)

(58) Field of Classification Search
None
See application file for complete search history.

(56) References Cited

U.S. PATENT DOCUMENTS

2011/0167514 A1* 7/2011 Brover .................. C07K 14/415
800/278
2013/0044919 A1* 2/2013 Purcell .................. G01N 21/25
382/110

FOREIGN PATENT DOCUMENTS

| WO | WO 2009/127441 | 10/2009 | |
|---|---|---|---|
| WO | WO 2010/068418 | 6/2010 | |
| WO | WO-2010068418 A2 * | 6/2010 | ......... C12N 15/8218 |
| WO | WO 2011/021190 | 2/2011 | |
| WO | WO-2011021190 A1 * | 2/2011 | ........... C07K 14/415 |
| WO | WO 2012/058223 | 5/2012 | |

OTHER PUBLICATIONS

Smith et al. (Nature Biotechnology, 15:1222-1223, 1997).*
Bork et al. (TIG, 12:425-427, 1996).*
Doerks et al., (TIG, 14:248-250, 1998).*
Nishimura et al. (Plant Cell Physiol., 41(5):583-590, 2000).*
Yang et al. (PNAS, 98:11438-11443, 2001).*
Reichmann et al. (Bio. Chem. 379(6):633-646-1998).*
Yang et al. (Plant Molecular Biology, 58:585-596, 2005).*
Hu et al. (Journal of Plant Physiology, 165:1717-1725, 2008).*
Zhao et al. (Planta, 227:1389-1399, 2008).*
Wells (Biochemistry 29:8509-8517, 1990).*
Guo et al. (PNAS, 101: 9205-9210, 2004 ).*
Ngo et al., (The Protein Folding Problem and Tertiary Structure Prediction, K. Merz., and S. Le Grand (eds.) pp. 492-495,1994).*
Thornton et al. (Nature structural Biology, structural genomics supplement, Nov. 2000).*
Keskin et al. (Protein Science, 13:1043-1055, 2004).*
International Search Report and Written Opinion regarding International Application No. PCT/US2015/040614, dated Jan. 14, 2016.
European Supplemental Search Report regarding European Application No. 15821980, dated Nov. 24, 2017.
Bhaskaran et al., "Accelerated Reactive Oxygen Scavenging System and Membrane Integrity of Two *Panicum* Species Varying in Salt Tolerance," *Cell Biochem Biophys* 67:885-892, 2013.
Dkhili et al., "Salt Effects on Seedling Growth of Switchgrass and Big Bluestem," *Proceedings of the Twelfth North American Prairie Conference*, pp. 13-16, 1990.
Lemus et al., "Nutrient Uptake by 'Alamo' Switchgrass Used as an Energy Crop," *Bioenerg. Res.* 2:37-50, 2009.
Mehterov et al., "Oxidative stress provokes distinct transcriptional responses in the stress-tolerant atr7 and stress-sensitive loh2 *Arabidopsis thaliana* mutants as revealed by multi-parallel quantitative real-time PCR analysis of ROS marker and antioxidant genes," *Plant Physiology and Biochemistry* 59:20-29, 2012.

* cited by examiner

*Primary Examiner* — Vinod Kumar
(74) *Attorney, Agent, or Firm* — Dentons US LLP

(57) ABSTRACT

Methods and materials for increasing abiotic stress tolerance in plants are disclosed. For example, nucleic acids encoding abiotic stress tolerance-increasing polypeptides are disclosed as well as methods for using such nucleic acids to transform plant cells. Also disclosed are plants having increased tolerance to abiotic stress and methods of increasing plant yield under abiotic stress conditions.

15 Claims, 45 Drawing Sheets
Specification includes a Sequence Listing.

Figure 1A

| SEQ_ID_NO_2 | MTNGI FSAMA | | GDQ- AYMI R | FDG- HFD DT | SPS SAGAEP | 35 |
|---|---|---|---|---|---|---|
| SEQ_ID_NO_6 | MTNRAFSAMA | | ASHQSSYMI R | FDGAHSD DP | SPS SAGAEP | 38 |
| SEQ_ID_NO_8 | MTNRI SAMG | | GNQ- EYMI R | FDG- HI D DA | SPS SATAEP | 34 |
| SEQ_ID_NO_13 | MTFSVSPATG | | ASQ- EYMI R | FDG- HFE DP | SSA AASAEP | 35 |
| SEQ_ID_NO_15 | ME- - - - - - - | | ASR- QYMI R | FDG- HFE E- | GPS SAAAEP | 26 |
| SEQ_ID_NO_20 | MHY- - - - - - - | | - - - - - - - - - | PNN- RTEFVG | APA - - - - - - | 15 |
| SEQ_ID_NO_22 | M- - - - - - - - - | | - - - - - - QR | SNK- RFREDG | - TSNTDQNNQ | 21 |
| SEQ_ID_NO_24 | MQR- - - - - - - | | - - - - - - - - - | SPK- RPKI NE | APS A TLFS | 20 |
| SEQ_ID_NO_25 | MQQR- - - - - - | | - - - - - - - - - | TPK- RQKHAS | APL- SAGETA | 22 |

| SEQ_ID_NO_2 | PEV- QVQVQQ | PPPFAG- RVI | SPEQEHQVI V | TAL LHVVSGY | 73 |
|---|---|---|---|---|---|
| SEQ_ID_NO_6 | PGPAQPQPQP | QPPFAGRRM | SPEQEHQVI V | AAL LHVVSGY | 78 |
| SEQ_ID_NO_8 | PPP- - - - - - | PRPFAG- RAI | SAEREHSVI V | ATL LHVI SGY | 69 |
| SEQ_ID_NO_13 | P- - LPP- - - | LPFAG- RAF | SPQQEQSAMV | AAL LHVVSGY | 64 |
| SEQ_ID_NO_15 | P- - - - - - - - | QPFAS- RAF | SPEQEQSVMV | AAL LHVVSGY | 55 |
| SEQ_ID_NO_20 | P- - - - - - - - | TRYQK- EQL | SPEQELSVI V | SAL QHVI SGE | 44 |
| SEQ_ID_NO_22 | Q- - - - - - - - | FPHF- - PRL | GEEEYSVMV | SAL KNVI NGS | 49 |
| SEQ_ID_NO_24 | P- - - - - - - - | PAAPP- LRL | TQEQELAVMV | AAL KNVVSGT | 49 |
| SEQ_ID_NO_25 | S- - - - - - - - | LQSPP- QRL | TPEQEGAI L V | AAL KTVI SGG | 51 |

| SEQ_ID_NO_2 | TTA- - - - - - | - - - - - - - - - | - - - - - - - - - - | - - - - - - - - - - | 76 |
|---|---|---|---|---|---|
| SEQ_ID_NO_6 | TTP- - - - - - | - - - - - - - - - | - - - - - - - - - | - - - - - - - - - - | 81 |
| SEQ_ID_NO_8 | RTP- - - - - - | - - - - - - - - - | - - - - - - - - - - | - - - - - - - - - - | 72 |
| SEQ_ID_NO_13 | TTP- - - - - - | - - - - - - - - - | - - - - - - - - - - | - - - - - - - - - - | 67 |
| SEQ_ID_NO_15 | ATP- - - - - - | - - - - - - - - - | - - - - - - - - - - | - - - - - - - - - - | 58 |
| SEQ_ID_NO_20 | NET- - - - - - | - - - - - - - - - | - - - - - - - - - - | - - - - - - - - - - | 47 |
| SEQ_ID_NO_22 | I PMENTQQFY | SFSPFQYCTA | TSTATTVTAY | SSPSNSMSTI | 89 |
| SEQ_ID_NO_24 | ASM- - - - - - | - - - - - - - - - | - - - - - - - - - - | - - - - - - - - - - | 52 |
| SEQ_ID_NO_25 | DAQ- - - - - - | - - - - - - - - - | - - - - - - - - - - | - - - - - - - - - - | 54 |

| SEQ_ID_NO_2 | VRQRPWGKWA | AEIRDPRRAV | RKWLGTFDTA | EEAAKAYDRA | 175 |
| --- | --- | --- | --- | --- | --- |
| SEQ_ID_NO_6 | VRQRPWGKWA | AEIRDPRRAV | RKWLGTFDTA | EEAARAYDQA | 195 |
| SEQ_ID_NO_8 | VRQRPWGKWA | AEIRDPRRAV | RKWLGTFDTA | EEAARAYDRA | 181 |
| SEQ_ID_NO_13 | VRQRPWGKWA | AEIRDPRRAV | RVWLGTFDTA | EDAARAYDRA | 169 |
| SEQ_ID_NO_15 | VRQRPWGKWA | AEIRDPRRAV | RVWLGTFDTA | EDAARAYDRA | 160 |
| SEQ_ID_NO_20 | VRQRPWGKWA | AEIRDPKRAT | RVWLGTFETA | EDAARAYDRA | 178 |
| SEQ_ID_NO_22 | VRQRPWGKFA | AEIRDPKAAA | RVWLGTFNTA | EDAARAYDRA | 197 |
| SEQ_ID_NO_24 | VRQRPWGKWA | AEIRDPRKAA | RVWLGTFNTA | EEAARAYDKA | 174 |
| SEQ_ID_NO_25 | VRQRPWGKWA | AEIRDPRRAA | RVWLGTFDTA | EAAARAYDKA | 162 |

| SEQ_ID_NO_2 | AVEFRGPRAK | LNFPFPEQAA | G----RIDEATS | NGDASAAARS | 212 |
| --- | --- | --- | --- | --- | --- |
| SEQ_ID_NO_6 | AIEFRGPRAK | LNFPFPEQLA | TGTGHDEA- | -SAAATTKS | 231 |
| SEQ_ID_NO_8 | AVEFRGPRAK | LNFPFPEQLS | A---HDDS- | NGDASAAAKS | 216 |
| SEQ_ID_NO_13 | AVEFRGPRAK | LNFSFPEQQQ | Q---QLGG- | SGNAAAAKS | 202 |
| SEQ_ID_NO_15 | AVKFRGPRAK | LNFSFPEQHL | R---DDSG- | NAAAAKS | 191 |
| SEQ_ID_NO_20 | AIGFRGPRAK | LNFPFVDYTS | S---VSS- | PVAADD | 208 |
| SEQ_ID_NO_22 | AIEFRGPRAK | LNFSFADYTE | L---QEQQ- | SASSSS | 228 |
| SEQ_ID_NO_24 | AIDFRGPRAK | LNFPFPDSGI | A---SFEE- | SKEKQE | 205 |
| SEQ_ID_NO_25 | AIDFRGPRAK | LNFPFPDNTL | L----TQNT- | -VETEQ | 192 |

| SEQ_ID_NO_2 | SDNT--LSPS | LCSGDAEL-ER | GQPAEWPRG- | ----GGQE | 242 |
| --- | --- | --- | --- | --- | --- |
| SEQ_ID_NO_6 | SDNTLSLSPS | LCSDEREREQ | GQPEWLPSA- | --GLGGQE | 266 |
| SEQ_ID_NO_8 | ---DIT--LSPS | PRSADADEQ | VEHTRWPQGG | GGGGGGGE | 251 |
| SEQ_ID_NO_13 | DACS--PSPS | PRSADEE | ---- | ---DE | 218 |
| SEQ_ID_NO_15 | DACS--PSPS | PRSAEE | ---- | ---EE | 207 |
| SEQ_ID_NO_20 | IGAN--ASAS | ---ASV- | ---- | ---SA | 221 |
| SEQ_ID_NO_22 | PQQL--PEPQ | LQQGNN- | ---- | ---TE | 244 |
| SEQ_ID_NO_24 | KQQE--I-SE | KRSEFE- | ---- | ---TE | 220 |
| SEQ_ID_NO_25 | PLQE--NQ | GNSEFL | ---- | ---AQ | 206 |

Figure 1D

| SEQ_ID | | | | | | | | |
|---|---|---|---|---|---|---|---|---|
| SEQ_ID_NO_2 | TGE- | ---- | ---- | ---- | QLW | EG- | ---- | LQDLMRL | 257 |
| SEQ_ID_NO_6 | TGE- | ---- | ---- | ---- | QLW | EG- | ---- | LQDLMKL | 281 |
| SEQ_ID_NO_8 | TGD- | ---- | ---- | ---- | QLW | EG- | ---- | LQDLMQL | 266 |
| SEQ_ID_NO_13 | TGD- | ---- | ---- | ---- | LLW | DG- | ---- | LVDLMKL | 233 |
| SEQ_ID_NO_15 | TGD- | ---- | ---- | ---- | LLW | DG- | ---- | LVDLMKL | 222 |
| SEQ_ID_NO_20 | TDSVEAEQWN | GGGGDCN | MEW | MN- | ---- | MMMMMDF | 250 |
| SEQ_ID_NO_22 | FGN- | ---- | ---- | ---- | EIW | DQ- | ---- | LMGDNEI | 259 |
| SEQ_ID_NO_24 | TGK- | --DN- | ---- | ---- | EFL | DNI | VDEELQE | -IMDF | 246 |
| SEQ_ID_NO_25 | TGD- | ---- | ---- | ---- | INE | NG- | ---- | FWEMIGN | 221 |

| SEQ_ID | | | | | | | | |
|---|---|---|---|---|---|---|---|---|
| SEQ_ID_NO_2 | DEAEL- | WFPP | TSN- | ---- | ---- | ---- | AWN | 272 |
| SEQ_ID_NO_6 | DEGEL- | WFPP | TSS- | ---- | ---- | ---- | AWN | 296 |
| SEQ_ID_NO_8 | DEGGL- | SWFPQ | SISD | ---- | ---- | ---- | SWN | 282 |
| SEQ_ID_NO_13 | DESDLCLLLP | VDNTL | DKFH- | IEGK | RRSGS- | GVPLCY | 266 |
| SEQ_ID_NO_15 | DESDLCLLLP | VDNTL | DKFH- | APGQ | RRSGS- | GVPLCY | 256 |
| SEQ_ID_NO_20 | GNGDS- | ---- | ---- | ---- | SDSGNT- | IADMFQ | 267 |
| SEQ_ID_NO_22 | QDWLT- | M | MN- | FN- | SDSSDSTG- | GNVHSV | 283 |
| SEQ_ID_NO_24 | GNGGS- | ---- | ---- | ---- | SNSSGTA | SAAATIGF | 266 |
| SEQ_ID_NO_25 | DQWMT- | M | VG- | ETG | GDSSDSATT | GNAHSF | 247 |

| SEQ_ID_NO | | | | | | | |
|---|---|---|---|---|---|---|---|
| SEQ_ID_NO_337 | MNLFQRAAAA | ALDAAEGFLV | SH--EKLHPL | PKTADPSVQI | 123 |
| SEQ_ID_NO_338 | LNFFQRAAAT | ALDAFEEGFV | ANVLERPHGL | SRTVDPAVQI | 114 |
| SEQ_ID_NO_342 | MNLFQRAAAS | ALDAAEGFLV | SH--ERQHQL | PKTADPSVQI | 116 |
| SEQ_ID_NO_347 | WNFLQSAAAM | ALDAVETALV | SH--ERQHPL | PKTADPGVQI | 116 |
| SEQ_ID_NO_352 | WNLVQKAAAM | ALDAVESALT | KH--ELEHPL | PKTADPRVQI | 128 |
| SEQ_ID_NO_362 | LNLFQRAAAA | ALDAFEEGFV | AGVLERPHGL | PRTADPAVQI | 125 |
| SEQ_ID_NO_364 | LNLFQRAAAA | ALDAFEEGFV | ANVLERPHGL | PSTADPAVQI | 131 |
| SEQ_ID_NO_365 | LNFFQRAAAA | ALDAFEEGFV | ANVLERPHGL | PSTADPAVQI | 123 |
| SEQ_ID_NO_366 | LNFFQRAAAV | ALDAFEEGFV | ANVLEKPHGL | SRTVDPAVQI | 119 |

| SEQ_ID_NO | | | | | | | |
|---|---|---|---|---|---|---|---|
| SEQ_ID_NO_337 | AGNFAPVNEQ | PVRRNLPVVG | KIPDSIKGVY | VRNGANPLHE | 163 |
| SEQ_ID_NO_338 | AGNFAPVGET | PPVQALPVTG | RIPPFINGVY | ARNGANPHFD | 154 |
| SEQ_ID_NO_342 | AGNFAPVNEQ | PVRRNLPVVG | KIPDSIKGVY | VRNGANPLHE | 156 |
| SEQ_ID_NO_347 | SGNFAPVPEQ | PVVQDLPVTG | KIPDCIQGAY | LRNGANPFHE | 156 |
| SEQ_ID_NO_352 | SGNFAPVPEN | PVCQSLPVTG | KIPDCIPKCVQGVY | VRNGANPLFE | 168 |
| SEQ_ID_NO_362 | AGNFAPVGER | PPAREPPVSG | RIPPFINGVY | ARNGANPCFD | 165 |
| SEQ_ID_NO_364 | AGNFAPVGER | PPVRELPVSG | RIPPFINGVY | ARNGANPCFD | 171 |
| SEQ_ID_NO_365 | AGNFAPVGER | PPVHELPVSG | RIPPFIDGVY | ARNGANPHFD | 163 |
| SEQ_ID_NO_366 | AGNFAPVGET | PPVQSLPVSG | RIPPFINGVY | ARNGANPHFD | 159 |

| SEQ_ID_NO | | | | | | | |
|---|---|---|---|---|---|---|---|
| SEQ_ID_NO_337 | PVTGHHFFDG | DGMVHAVKFE | DGSAL-SYACR | FTQTNRFVQE | 202 |
| SEQ_ID_NO_338 | PVAGHHLFDG | DGMVHALRIR | NGVAETYASR | FTETERLQQE | 194 |
| SEQ_ID_NO_342 | PVTGHHFFDG | DGMVHAVKFE | DGTA-SYACR | FTQTNRFIQE | 195 |
| SEQ_ID_NO_347 | PVAGHHFFDG | DGMVHAVQFK | KGSV-SYSSR | FTETNRLVQE | 195 |
| SEQ_ID_NO_352 | PTAGHHFFDG | DGMVHAVQFK | NGSA-SYACR | FTETERLVQE | 207 |
| SEQ_ID_NO_362 | PVAGHHLFDG | DGMVHALRIR | NGVAESYACR | FTETARLRQE | 205 |
| SEQ_ID_NO_364 | PVAGHHLFDG | DGMVHALRIR | NGAAESYACR | FTETARLTQE | 211 |
| SEQ_ID_NO_365 | PVAGHHLFDG | DGMVHALRIR | NGAAESYACR | FTETARLRQE | 203 |
| SEQ_ID_NO_366 | PVAGHHLFDG | DGMVHALRIR | NGVAETYASR | FTDTERLRQE | 199 |

Figure 2C

| | | | | | |
|---|---|---|---|---|---|
| SEQ_ID_NO_337 | RQL GRP VFPK | AI GELHGHTG | ARLMLFYAR | AAAGI VGPAH | 242 |
| SEQ_ID_NO_338 | RAL GRPMFPK | AI GELHGHSG | ARLALFYAR | AACGL_DPSR | 234 |
| SEQ_ID_NO_342 | RRL GRPVFPK | AI GELHGHTG | ARLMLFYAR | AAAGLVDPAH | 235 |
| SEQ_ID_NO_347 | RGL GRPLFPK | AI GELHGHSG | ARLLFYAR | GAFGI VDPSH | 235 |
| SEQ_ID_NO_352 | KAL GRPVFPK | AI GELHGHSG | ARLMLFYAR | GLFGLVDHSK | 247 |
| SEQ_ID_NO_362 | RAI GRPVFPK | AI GELHGHSG | ARLALFYAR | AACGLVDPSH | 245 |
| SEQ_ID_NO_364 | RAI GRPVFPK | AI GELHGHSG | ARLALFYAR | AACGLVDPSA | 251 |
| SEQ_ID_NO_365 | RAI GRPVFPK | AI GELHGHSG | ARLALFYAR | AACGLVDPSA | 243 |
| SEQ_ID_NO_366 | RAL GRPMFPK | AI GELHGHSG | ARLALFYAR | SACGLVDPSR | 239 |

| | | | | | |
|---|---|---|---|---|---|
| SEQ_ID_NO_337 | GT GVANAGLV | YFNGRLLAMS | EDDLPYQVRI | TPNGDLKTVG | 282 |
| SEQ_ID_NO_338 | GT GVANAGLV | YFNGHLLAMS | EDDI PYHVRV | TDDGDLQTVG | 274 |
| SEQ_ID_NO_342 | GT GVANAGLV | YFNNRLLAMS | EDDLPYQVRI | TPSGDLKTVG | 275 |
| SEQ_ID_NO_347 | GT GVANAGLV | YFDGHLLAMS | EDDLPYHVRV | GAFGDLQTVG | 275 |
| SEQ_ID_NO_352 | GT GVANAGLKT | YFNNRLLAMS | EDDLPYHVKV | LPSGDLKTVG | 287 |
| SEQ_ID_NO_362 | GT GVANAGLV | YFNGHLLAMS | EDDLPYHVRV | TPTGDLKTEG | 285 |
| SEQ_ID_NO_364 | GT GVANAGLV | YFNGHLLAMS | EDDLPYHVRV | TDGGDLETVG | 291 |
| SEQ_ID_NO_365 | GT GVANAGLV | YFNGRLLAMS | EDDLPYHVRV | ADDGDLETVG | 283 |
| SEQ_ID_NO_366 | GT GVANAGLV | YFNGHLLAMS | EDDI PYHVRV | TEAGDLQTVG | 279 |

| | | | | | |
|---|---|---|---|---|---|
| SEQ_ID_NO_337 | RFNFDGQLES | TMI AHPKVDP | ESGELFALSY | DVVSKPYLKY | 322 |
| SEQ_ID_NO_338 | RYDFDGQLEC | PMI AHPKLDP | ATGELHALSY | DVI KKPYLKY | 314 |
| SEQ_ID_NO_342 | RYDFNGQLES | TMI AHPKVDP | ESGELFALSY | DVVSKPFLKY | 315 |
| SEQ_ID_NO_347 | RYDFDGQLKT | TMI AHPKLDP | VSGELFALSY | DVVQKPYLKY | 315 |
| SEQ_ID_NO_352 | RFDFDGQLKS | TMI AHPKLDP | VSGELHALSY | DVI QKPYLKY | 327 |
| SEQ_ID_NO_362 | RYDFDGQLGC | AMI AHPKLDP | ATGELHALSY | DVI KKPYLKY | 325 |
| SEQ_ID_NO_364 | RYDFDGQLGC | AMI AHPKLDP | VTGELHALSY | DVI KKPYLKY | 331 |
| SEQ_ID_NO_365 | RYDFDGQLGC | AMI AHPKLDP | ATGELHALSY | DVI KRPYLKY | 323 |
| SEQ_ID_NO_366 | RYDFDGQLEC | PMI AHPKLDP | ATGQLHALSY | DVI KKPYLKY | 319 |

Figure 2D

| SEQ_ID_NO_337 | FRFSPDGTKS | PDVEI QLDQP | TMMHDFAI TE | NFVVVPDQQV | 362 |
| --- | --- | --- | --- | --- | --- |
| SEQ_ID_NO_338 | FYFAADGTKS | ADVEI PLDQP | TMI HDFAI TE | NYVVVPDHQV | 354 |
| SEQ_ID_NO_342 | FRFSPEGI KS | PDVEI NLDQP | TMMHDFAI TE | NFVVI PDQQV | 355 |
| SEQ_ID_NO_347 | FRFSPDGKKS | PNVEI PLDQP | TMMHDFAI TE | RFVVVPDQQV | 355 |
| SEQ_ID_NO_352 | FRFSKNGEKS | NDVEI PVEDP | TMI HDFAI TE | NFVVI PDQQV | 367 |
| SEQ_ID_NO_362 | FYFRPDGTKS | DDVEI PLDQP | TMI HDFAI TE | NFVVVPDHQV | 365 |
| SEQ_ID_NO_364 | FYFRPDGTKS | DDVEI PLDQP | TMI HDFAI TE | NFVVVPDHQV | 371 |
| SEQ_ID_NO_365 | FYFRPDGTKS | DDVEI PLEQP | TMI HDFAI TE | NLVVVPDHQV | 363 |
| SEQ_ID_NO_366 | FYFAADGTKS | ADVEI PLDQP | TMI HDFAI TE | NFVVVPDHQV | 359 |

| SEQ_ID_NO_337 | VFKLPEMI RG | GSPVVYDKNK | VARFGI LDKY | AEDSSNI KW | 402 |
| --- | --- | --- | --- | --- | --- |
| SEQ_ID_NO_338 | VFKLQEMLRG | GSPVVLDKEK | TSRFGVLDKY | AADASEMVW | 394 |
| SEQ_ID_NO_342 | VFKLPEMI RG | GSPVVYDKEK | VARFGVLDKY | AGDSSAI RW | 395 |
| SEQ_ID_NO_347 | VFKLPEMI RG | GSPVI YDKNK | MARFGI LDKN | ATDASNI RW | 395 |
| SEQ_ID_NO_352 | VFKMSEMI RG | GSPVVYDKNK | VSRFGI LDKY | AKDGSDLKW | 407 |
| SEQ_ID_NO_362 | VFKLQEMLRG | GSPVVLDKEK | TSRFGVLPKH | AKDASEMAW | 405 |
| SEQ_ID_NO_364 | VFKLQEMLRG | GSPVVLDKEK | TSRFGVLPKH | ASDASEMVW | 411 |
| SEQ_ID_NO_365 | VFKLQEMLRG | GSPVVLDKEK | TSRFGVLPKH | AADASEMAW | 403 |
| SEQ_ID_NO_366 | VFKLQEMLRG | GSPVVLDKEK | TSRFGVLPKC | AADASEMVW | 399 |

| SEQ_ID_NO_337 | DAPDCFCFHL | WNAWEEPETD | EVVVI GSCMT | PPDSI FNESD | 442 |
| --- | --- | --- | --- | --- | --- |
| SEQ_ID_NO_338 | DVPDCFCFHL | WNAWEEEETD | EVVVI GSCMT | PADSI FNESD | 434 |
| SEQ_ID_NO_342 | EAQECFCFHL | WNAWEEPETE | EI VVI GSCMT | PPDSI FNEAD | 435 |
| SEQ_ID_NO_347 | ETPDCFCFHL | WNAWEEPETD | EVVVI GSCMT | PPDSI FNECD | 435 |
| SEQ_ID_NO_352 | EVPDCFCFHL | WNAWEEAETD | EI VVI GSCMT | PPDSI FNECD | 447 |
| SEQ_ID_NO_362 | DVPDCFCFHL | WNAWEDEETG | EVVVI GSCMT | PADSI FNESD | 445 |
| SEQ_ID_NO_364 | DVPDCFCFHL | WNAWEDEATG | EVVVI GSCMT | PADSI FNESD | 451 |
| SEQ_ID_NO_365 | DVPDCFCFHL | WNAWEDEATG | EVVVI GSCMT | PADSI FNESD | 443 |
| SEQ_ID_NO_366 | DVPDCFCFHL | WNAWEEDTD | EVVVI GSCMT | PADSI FNESD | 439 |

Figure 2E

| SEQ_ID_NO | | | | | | | | | |
|---|---|---|---|---|---|---|---|---|---|
| SEQ_ID_NO_337 | ENLKGVLSEI | RLNLKTGEST | RRPISNEDQ | QVNLEAGMVN | 482 |
| SEQ_ID_NO_338 | ECLESVLTEI | RLNTRTGEST | RRPILA_LSE | QVNLEVGMVN | 473 |
| SEQ_ID_NO_342 | ENLESVLSEI | RLNLRTGEST | RRPI_SDGEE | QVNLEAGMVN | 475 |
| SEQ_ID_NO_347 | ESLKSVLSEI | RLNLKTGKST | RRQI_LS_EAD | QVNLEAGMVN | 474 |
| SEQ_ID_NO_352 | EGLKSVLSEI | RLDTRTGKST | RKSI_ENPDE | QVNLEAGMVN | 487 |
| SEQ_ID_NO_362 | EHLESVLTEI | RLDTRTGRSS | RRAILP_PSQ | QVNLEVGMVN | 484 |
| SEQ_ID_NO_364 | ERLESVLTEI | RLDTRTGRST | RRAVLP_PSQ | QVNLEVGMVN | 490 |
| SEQ_ID_NO_365 | ERLESVLTEI | RLDARTGRST | RRAVLP_PSQ | QVNLEVGMVN | 482 |
| SEQ_ID_NO_366 | ECLESVLTEI | RLNTRTGEST | RRPILA_PSQ | QVNLEVGMVN | 478 |

| SEQ_ID_NO | | | | | | | | | |
|---|---|---|---|---|---|---|---|---|---|
| SEQ_ID_NO_337 | RNVLGRKTKF | AYLALAEPWP | KVSGFAKVDL | TITGEVKKHLY | 522 |
| SEQ_ID_NO_338 | SNLLGRKTRY | AYLAVAEPWP | KVSGFAKVDL | ATGELTKFEY | 513 |
| SEQ_ID_NO_342 | RNMLGRKTRF | AYLALAEPWP | KVSGFAKVDL | FTGEVKKYLY | 515 |
| SEQ_ID_NO_347 | RNLLGRKSRF | AYLAI_AEPWP | KVSGFAKVNL | STGEVHKYIY | 514 |
| SEQ_ID_NO_352 | RNKLGRKTEY | AYLAVAEPWP | KVSGFAKVDL | FTGEVEKFIY | 527 |
| SEQ_ID_NO_362 | RNLLGRKTRY | AYLAVAEPWP | KVSGFAKVDL | ATGELTKFEY | 524 |
| SEQ_ID_NO_364 | RNLLGRKTRY | AYLAVAEPWP | KVSGFAKVDL | E_TGELTKFEY | 530 |
| SEQ_ID_NO_365 | RNLLGRETRY | AYLAVAEPWP | KVSGFAKVDL | STGELTKFEY | 522 |
| SEQ_ID_NO_366 | STLLGRKTRY | AYLAVAEPWP | KVSGFAKVDL | ATGELTKFDY | 518 |

| SEQ_ID_NO | | | | | | | | | |
|---|---|---|---|---|---|---|---|---|---|
| SEQ_ID_NO_337 | GDNRYGGEPL | FLPGEG---- | -GEEDEGYIL | CFVHDEKTWK | 557 |
| SEQ_ID_NO_338 | GEGRFGGEPC | FVPMDPAT-- | SRGEDDGYIL | TFVHDEAAGT | 551 |
| SEQ_ID_NO_342 | GGDRYGGEPL | FLPGDEN--- | -RAEDDGYIL | CFVHDEETWK | 551 |
| SEQ_ID_NO_347 | GDQKFGGEPL | FLPRDPNS-- | -EREDDGYIL | AFVHDEKEWK | 551 |
| SEQ_ID_NO_352 | GDNKYGGEPL | FLPRDPNSL- | -KEEDDGYIL | AFVHDEKEWK | 564 |
| SEQ_ID_NO_362 | GEGRFGGEPC | FVPMDPAAAH | PRGEDDGYVL | TFVHDERAGT | 564 |
| SEQ_ID_NO_364 | GEGRFGGEPC | FVPMDPSAAH | PRGEDDGYVL | TFVHDERAGT | 570 |
| SEQ_ID_NO_365 | GEGRFGGEPC | FVPMDPAAAH | PRGEDDGYVL | TFVHDERAGT | 562 |
| SEQ_ID_NO_366 | GEGRFGGEPC | FVPMDPAAAS | PRGEDDGYIL | TFVHDERAGT | 558 |

Figure 2F

| | | | | | |
|---|---|---|---|---|---|
| SEQ_ID_NO_337 | SELQIVNAVS | LEVEATVKLP | SRVPYGFHGT | FIGADDLAKQ | 597 |
| SEQ_ID_NO_338 | SELLVVNAAD | MRLEATIQLP | SRVPYGFHGT | FITGKELESQ | 591 |
| SEQ_ID_NO_342 | SELQIVNAVS | LEVEATVKLP | SRVPYGFHGT | FIGANDLATQ | 591 |
| SEQ_ID_NO_347 | SELQIVNAMN | LKLEATVKLP | SRVPYGFHGT | FIGAKDLEKQ | 591 |
| SEQ_ID_NO_352 | SELQIVNAMS | LKLEATVQLP | SRVPYGFHGT | FINANDLANQ | 604 |
| SEQ_ID_NO_362 | SELLVVNAVD | MRLEATVQLP | SRVPFGFHGT | FITASELEAQ | 604 |
| SEQ_ID_NO_364 | SELLVVNAAD | MRLEATVQLP | SRVPFGFHGT | FITGKELEAQ | 610 |
| SEQ_ID_NO_365 | SELLVVNAAD | MRLEATVQLP | SRVPFGFHGT | FITGQELEAQ | 602 |
| SEQ_ID_NO_366 | SELLVVNAAD | MRLEATIQLP | SRVPYGFHGT | FVKASELESQ | 598 |

| | |
|---|---|
| SEQ_ID_NO_337 | VV 599 |
| SEQ_ID_NO_338 | -A 592 |
| SEQ_ID_NO_342 | -V 592 |
| SEQ_ID_NO_347 | -A 592 |
| SEQ_ID_NO_352 | -A 605 |
| SEQ_ID_NO_362 | -A 605 |
| SEQ_ID_NO_364 | AA 611 |
| SEQ_ID_NO_365 | AA 604 |
| SEQ_ID_NO_366 | -A 599 |

Figure 3A

| SEQ_ID_NO | | | | | |
|---|---|---|---|---|---|
| SEQ_ID_NO_61 | MSE------ | EKRKQHFVLV | HGACHGAWCW | YKVKPLLEAL | 33 |
| SEQ_ID_NO_82 | MEVD----- | RKQGRHFVLV | HGACHGAWSW | YKVKPRLEAA | 34 |
| SEQ_ID_NO_71 | MEEVV---- | GMEEKHFVLV | HGVNHGAWCW | YKLKARLVAG | 35 |
| SEQ_ID_NO_88 | MVE------ | TKNQKHFVLV | HGACHGAWCW | QKFKTLLESA | 33 |
| SEQ_ID_NO_86 | MK------- | -EGKHFVLV | HGAGHGAWCW | YKLKPLLEAA | 30 |
| SEQ_ID_NO_98 | MEAN----- | KKQGKHFVLV | HGACHGAWCW | YKLKPLLEAA | 34 |
| SEQ_ID_NO_89 | MHSAA---N | AKQQKHFVLV | HGGCLGAWIW | YKLKPLLESA | 36 |
| SEQ_ID_NO_108 | ME------- | --VMKHFVTV | HGVGHGAWYY | YKLKPRIEAA | 30 |
| SEQ_ID_NO_81 | MNYGEGRGDG | --QSKHYMVV | HGACHGAWSW | HKVTTQLRSA | 40 |
| SEQ_ID_NO_96 | M-------- | SCNKKHLLV | HGMSHGAWCW | YKLKPLLESA | 29 |
| SEQ_ID_NO_77 | MS------- | -PTKHFVAV | HGVGHGAWYY | YKLKPRIEAA | 30 |

| SEQ_ID_NO | | | | | |
|---|---|---|---|---|---|
| SEQ_ID_NO_61 | GHRVTALDLA | ASGI DTTRSI | TDI STCEQYS | EPLMQLMTSL | 73 |
| SEQ_ID_NO_82 | GHRVTALDMA | ASGI NR-KQI | QEVHSMHEYS | QPLLEMMATL | 73 |
| SEQ_ID_NO_71 | GHRVTAVDLA | ASGI NM-KRI | EDVHTFHAYS | EPLMEVLASL | 74 |
| SEQ_ID_NO_88 | SNRVTVLDLA | ASGI KAI | QDVETLDEYT | EPLLEFLASL | 72 |
| SEQ_ID_NO_86 | GHKVTALDLA | ASGT DL-RKI | EELRTLYDYT | LPLMELMESL | 69 |
| SEQ_ID_NO_98 | GHKVTAVDLA | ASGI DL-RKI | EQLHTLHDYT | PLLELMESL | 73 |
| SEQ_ID_NO_89 | GHRCTAVNLA | AAGI NP-RRL | DEI HTFRDYS | EPLMEVMASI | 75 |
| SEQ_ID_NO_108 | GYQVTVPDLA | ASGVDE-KKL | EEVRSSI DYA | APLLEVLDSV | 69 |
| SEQ_ID_NO_81 | GHRVTALDMG | ASGVNM-RRF | QDLRSFI HYS | QPLLDI LACL | 79 |
| SEQ_ID_NO_96 | GFKFTAI DLA | AAGVNP-RPV | EELRSFRDYN | APLLSFMSSL | 68 |
| SEQ_ID_NO_77 | GFKFTAI DLA | AAGVNP-KKL | EEVNSLEEYC | GPLFDVLAAV | 69 |

Figure 3B

| SEQ_ID_NO_61 | PNDEKVVLVG | HSFGGLSLAL | AMDKFPDKIS | VSVFVTAFMP | 113 |
|---|---|---|---|---|---|
| SEQ_ID_NO_82 | PPNEKVILVG | HSLGGLNLAV | AMEKFPEKVS | VAVFLTAFMP | 113 |
| SEQ_ID_NO_71 | PAEEKVILVG | HSLGGVTLAL | AGDKFPHKI | VAVFVTAFMP | 114 |
| SEQ_ID_NO_88 | QPKEKVILVG | HSLGGLSLAL | AMEKFPEKIA | VAVFLSAFMP | 112 |
| SEQ_ID_NO_86 | SADEKVILVG | HSLGGMNLGL | AMEKYPQKIY | VAVFLAAFMP | 109 |
| SEQ_ID_NO_98 | PQEEKAILVG | HSLGGMNLAL | AMEKYPKKIY | AAVFLAAFMP | 113 |
| SEQ_ID_NO_89 | PPDEKVVLLG | HSFGGMSLGL | AMETYPEKIS | VAVFMSAMMP | 115 |
| SEQ_ID_NO_108 | PENEKVILVG | HSGGGMTAAV | GMEKFPNKI | LAVFLNAI MP | 109 |
| SEQ_ID_NO_81 | PPGERVILVG | HSLGGLNIAL | AMDRFPEKIA | AAVFVTALMP | 119 |
| SEQ_ID_NO_96 | PEDDKVVLVG | HSLGGINIAF | AMEEFPEKVS | AAVFVAALVP | 108 |
| SEQ_ID_NO_77 | PEGEKVILVG | HSGGGLSAAV | GMEKFPKKIS | VAVFLNAI MP | 109 |

| SEQ_ID_NO_61 | DTKHSPSFVE | EKFASSMT- | PEGWMGSELE | TYGSDNSL-GL | 150 |
|---|---|---|---|---|---|
| SEQ_ID_NO_82 | DTLHRPSYVL | DQYVERTP- | NDAWLDTQFS | PYGSSEKPQN | 151 |
| SEQ_ID_NO_71 | DTTHRPSFVL | EQYSEKMGKE | DDSWLDTQFS | QCDASNPSHI | 154 |
| SEQ_ID_NO_88 | DTTHKPSFVL | DQYNERTP- | ADSWLDTQFL | PYSSSQSHLT | 150 |
| SEQ_ID_NO_86 | DSVHNSSFVL | EQYNERTP- | AENWLDTQFL | PYGSPEEPLT | 147 |
| SEQ_ID_NO_98 | DSLHLSSYYM | DQYNERTP- | AENWLDTQFL | PYGTPEEPLT | 151 |
| SEQ_ID_NO_89 | DIPNHSLTYPF | EKYNEKCP- | ADMMLDSQFS | TYGNPENPGM | 153 |
| SEQ_ID_NO_108 | DTENRPSYVL | EEYTAKTP- | PEAWKDCQFS | AYGDP- -PIT | 145 |
| SEQ_ID_NO_81 | DSVNPPSYVM | DKLKKEKT- | MLFWSDTQFG | LVGDEDKGPV | 157 |
| SEQ_ID_NO_96 | DTVNKPSFFL | DELFKKLG-A | ANGWMDCQFS | TFGSPDEPVT | 147 |
| SEQ_ID_NO_77 | DTKNRPSYVM | EEYTARTP- | IEAWKDTQFS | AYGEP- -PIT | 145 |

Figure 3C

| SEQ_ID_NO_61 | SVFFSTDFMK | HRLYQLSPVE | DLELGLLLKR | PSSLFINELS | 190 |
|---|---|---|---|---|---|
| SEQ_ID_NO_82 | SMFFGPEFIS | TKLYQLSPIE | DLELVLALAR | PASLFLEDLA | 191 |
| SEQ_ID_NO_71 | SMLFGREFLT | IKIYQLSPIE | DLELAKMLVR | PGSMFIDNLS | 194 |
| SEQ_ID_NO_88 | TMSFGPKFLS | SKLYQLSPPE | DLEQAKTMVR | PGSLFLYDLS | 190 |
| SEQ_ID_NO_86 | SMFFGPKFLA | HKLYQLCSPE | DLALASSLVR | PSSLFMEDLS | 187 |
| SEQ_ID_NO_98 | SMFFGPKFLA | DKLYRLSPPE | DVALGLSLVR | TSSLFLEDLS | 191 |
| SEQ_ID_NO_89 | SMILGPQFMA | LKMFQNCSVE | DLELAKMLTR | PGSLFFQDLA | 193 |
| SEQ_ID_NO_108 | SLVCGPEFIS | STLYHLSPIE | DHALGKILVR | PGSLFIEDLL | 185 |
| SEQ_ID_NO_81 | SLLFGPKFLS | -KLYTRSPPE | DLTLARTLMR | PSSFFLEDLG | 196 |
| SEQ_ID_NO_96 | VISFGPKFLS | -LLYDSSPIE | DYELAKMLTR | PLPNYVTDLG | 186 |
| SEQ_ID_NO_77 | ALLCGPEFIS | TSLYHLSPVE | DHTLGKLLVR | PGALFVEDLL | 185 |

| SEQ_ID_NO_61 | K-MENFSEKG | YGSVPRAYIV | CKEDNISED | HQRWMIHNY- | 228 |
|---|---|---|---|---|---|
| SEQ_ID_NO_82 | E-LKKFSNEG | YGSVSTSVFIR | CDKDEAIRKE | FQQWMIENSG | 230 |
| SEQ_ID_NO_71 | K-ESKFSDEG | YGSVKRVYLV | CEEDIGLPKQ | FQHWMIQNY- | 232 |
| SEQ_ID_NO_88 | K-ANSFSTTG | FGSVKRVYI-V | CDEDLAIPEE | FQRWQIENS- | 228 |
| SEQ_ID_NO_86 | K-AKYFTDER | YGSVKRVYVV | CTEDKGIPEE | FQRWQIDNI- | 225 |
| SEQ_ID_NO_98 | K-AKYLTDEG | YGSVKRVYVV | CTEDKGISKE | FQQWQIDNI- | 229 |
| SEQ_ID_NO_89 | K-AKKFSTER | YGSVKRAYIF | CNEDKSFPVE | FQKWFVESV- | 231 |
| SEQ_ID_NO_108 | K-AEKFTEEG | FGSVPRVYVI | AAEDKTIPPE | FQRWMIENN- | 223 |
| SEQ_ID_NO_81 | S-MPPFSESG | YGSVEKIYVV | CAQDEILTEG | FQRWMIENN- | 234 |
| SEQ_ID_NO_96 | K-AEKLSDGK | YGSVRRVYVI | CKEDKAIPDE | LVGQMIEWN- | 224 |
| SEQ_ID_NO_77 | KGAVKFTDEG | FGSVPRVYVV | ATEDKTIPPE | FQRWMIENN- | 224 |

Figure 3D

| SEQ_ID_NO_61 | PANLVI EME E | T DHMPMF CKP | QVL SDHL LAI | ADNFS | 263 |
| --- | --- | --- | --- | --- | --- |
| SEQ_ID_NO_82 | GVKEVMNI KD | ADHMAMF SKP | EEL CACL LEV | AHKYG | 265 |
| SEQ_ID_NO_71 | PVNEVMEI KG | GDHMAML SDP | QKL CDCL SQI | SLKYA | 267 |
| SEQ_ID_NO_88 | AVEEVMEI EG | ADHMVMF SKP | QEL FHCL SEI | ANKHA | 263 |
| SEQ_ID_NO_86 | GVTEAI EI KG | ADHMAML CEP | QKL CASL LEI | AHKYN | 260 |
| SEQ_ID_NO_98 | GVTEAKEI KG | ADHMAML CMP | KKL CDTL VEI | ADKYN | 264 |
| SEQ_ID_NO_89 | GADKVKEI KE | ADHMGML SQP | REV CKCL LDI | SD - - S | 264 |
| SEQ_ID_NO_108 | PVKEVKEI KG | ADHMPMF SKP | DEL SQCL LDI | AKKHA | 258 |
| SEQ_ID_NO_81 | PVKEVRELED | ADHMPMF STP | KQL FQCL SDV | ADACA | 269 |
| SEQ_ID_NO_96 | GL KEVI EL QG | ADHMP ML SNP | QQL CDCL VQI | AVENP | 259 |
| SEQ_ID_NO_77 | PVAEVKEI EG | ADHL PQF SKP | DEL TQVL VDI | AKNHG | 259 |

Figure 4A

| SEQ_ID_NO_111 | MGKRGKWFSA | VKKVFSSSDP | DGKEAKAQKA | DKSKSKRRWP | 40 |
| SEQ_ID_NO_113 | MGKKGKWFSA | VKKVFSSSDP | DGKEAKAEKA | DKSKSKRRWP | 40 |
| SEQ_ID_NO_115 | MGKKGKWFSA | VKKVFGSSDP | DGKQAKAEKA | DKSKSRRRWP | 40 |
| SEQ_ID_NO_116 | MGKKGKWFSA | VRRVFSSSDP | DGREAKIEKA | DKSRSRRKWP | 40 |
| SEQ_ID_NO_117 | MGKKGNWFSA | VKKALSPE- | EAKEAKAEKA | DKPKSKKKWP | 40 |
| SEQ_ID_NO_118 | MGKKGNWFSA | LKKALGSSK- | PKEKKDK--- | TTPKSKKKW- | 34 |
| SEQ_ID_NO_120 | MGKKGRGSWFSA | VKKALSPE- | -------- | -KSKSKKKW- | 27 |
| SEQ_ID_NO_122 | MGKKGGMLSL | VKKALSPE- | SKKSQH--- | QTPKPKKKW- | 33 |
| SEQ_ID_NO_123 | MGKKGSWFSA | VKKVFSSDS- | -------- | -KKDKKKQK- | 27 |
| SEQ_ID_NO_124 | MGK--SWFSA | VKKALSPE- | PKQKKE--- | QKPHKSKKW- | 31 |

| SEQ_ID_NO_111 | FGKSK-HSEP | SI STVPGTAP | AVAPLP---- | PPA---TQPH | 73 |
| SEQ_ID_NO_113 | FGKTKKHSEP | SL STVAGTAP | -VAPLP---- | PPPL--TQPH | 73 |
| SEQ_ID_NO_115 | FGKSR-HSDP | SASTVSGTAP | -VAPLP---P | PPPL-TQPH | 75 |
| SEQ_ID_NO_116 | FGKSK-HSDL | WTSTVAVPTS | -TAPPPQPPP | PPPTHPLQPQ | 78 |
| SEQ_ID_NO_117 | FGKSK-NLDP | PTSTVSGITL | VAPQP---LP | PPPTQPPQPQ | 76 |
| SEQ_ID_NO_118 | FGKHK-NLDP | VSSSTENA-- | ---MPLP--- | PA------- | 58 |
| SEQ_ID_NO_120 | SEKEK-NRDL | GVSSHEET-- | -VAPSL---- | PPR------- | 56 |
| SEQ_ID_NO_122 | FGKSK-NLSP | VSVPEETE-- | --------- | --------- | 50 |
| SEQ_ID_NO_123 | SDKSK-KAL- | --SSDKDA-- | EAAV----L- | -P------- | 47 |
| SEQ_ID_NO_124 | FGKSK-KLDV | TNSGAAYS-- | --------- | -TPP----- | 48 |

| SEQ_ID_NO_111 | SLEI KDVNPV | ETDSEQNKHA | YSVALASAVA | AEAAVAAAQA | 113 |
| SEQ_ID_NO_113 | SLEI KDVNPL | ETDSEQNKHA | YSVALASAVA | AEAAVAAAQA | 113 |
| SEQ_ID_NO_115 | SQEI KDVKPV | ETDSEQNKHA | YSVALASAVA | AEAAVAAAQA | 115 |
| SEQ_ID_NO_116 | PEEI KDVKAV | EAESEQNKHA | YSVALATAVA | AEAAVAAAQA | 118 |
| SEQ_ID_NO_117 | SEEI KDVKTI | EAENEQSKHA | YSVALATAVA | AEAAVAAAQA | 116 |
| SEQ_ID_NO_118 | -PPI EDVKLT | EAENEQSKHA | YSVALATAVA | AEAAVAAAHA | 97 |
| SEQ_ID_NO_120 | PPTAEDVKLT | EAEKEQSKHA | YSVALATAVA | AEAAVAAAQA | 96 |
| SEQ_ID_NO_122 | -VITEDAKLI | EAEKEQSKHA | ASLAFATAVA | AEAAVAAAQA | 89 |
| SEQ_ID_NO_123 | --PI EDAKLI | ENEEQQSRHA | YSVAI ATAVA | AEAAVAAAQA | 85 |
| SEQ_ID_NO_124 | PRTVKDAKLK | -------- | YSVAI ATAAA | AEAAVAAAQA | 88 |

| SEQ_ID_NO | | | | | |
|---|---|---|---|---|---|
| SEQ_ID_NO_111 | TEKLEVPERA | PLAH- | SVVKK | RLSFPVVEKP | SVVPTEKPRE | 476 |
| SEQ_ID_NO_113 | TEKLEVPERA | PLVH- | SVVKK | RLSFPVVDKP | SVVPTDKPKE | 476 |
| SEQ_ID_NO_115 | TEKLELSERA | PLAH- | SVVNK | RLSFPV-DKP | SRPPADKPKE | 476 |
| SEQ_ID_NO_116 | TDRFEVPERV | PLVH- | SSIKK | RLSFPVADKP | NGEHADKLME | 478 |
| SEQ_ID_NO_117 | TDKFEVPERV | SLVH- | SSIKK | RLSFPAADKP | N-APADKPME | 476 |
| SEQ_ID_NO_118 | LEKNGTPEKA | SL-G- | SSAKK | RLSFPASP-- | ------A--- | 457 |
| SEQ_ID_NO_120 | IDNNGTPDKA | SV--- | GYVKK | RLSFSASE-- | -----PA--- | 455 |
| SEQ_ID_NO_122 | --SGTPDRR | V-A- | GSARK | RLLFPASP-- | -----A---- | 443 |
| SEQ_ID_NO_123 | -HSPEKK-- | GGGGS | VSARK | RLSFSPSS-- | -----AA--- | 431 |
| SEQ_ID_NO_124 | -------- | S-E- | KTAKK | RLSFSGSP-- | -------K-- | 407 |

| SEQ_ID_NO | | | | | |
|---|---|---|---|---|---|
| SEQ_ID_NO_111 | RVRRHSDPPK | VDPATL | KDA | ---------- | --PAA | 498 |
| SEQ_ID_NO_113 | RVRRHSDPPK | VDPATL | KDV | ---------- | --PAA | 498 |
| SEQ_ID_NO_115 | RVRRHSDPPK | VDPATL | KDA | ---------- | --PVA | 498 |
| SEQ_ID_NO_116 | RGRRHSDPPK | VDPASL | KDV | ---------- | --PVS | 500 |
| SEQ_ID_NO_117 | RARRHSEPPK | VETSSI | KAI | ---------- | ----- | 492 |
| SEQ_ID_NO_118 | GPRRHSGPPR | VDASAV | KDI | SP-------- | -AHRG | 482 |
| SEQ_ID_NO_120 | GARRHSGPPR | VDI-SEA- | RKN | QMHREEKMSN | G-ASSK | 489 |
| SEQ_ID_NO_122 | SSRRHSEPPK | VEM--- | --- | QHA---PSN | GRQVAW | 474 |
| SEQ_ID_NO_123 | NSRRHSDPPK | ------ | --- | ---------- | ------ | 444 |
| SEQ_ID_NO_124 | TVRRFSGPPK | LESNVTKKDT | --- | ---------- | --NLA | 430 |

Figure 5A

| | | | | | |
|---|---|---|---|---|---|
| SEQ_ID_NO_27 | MSITHSL- | ---- | ---- | SSSAFLA-PS | 22 |
| SEQ_ID_NO_29 | MSLMNNL- | ---- | TTP- | SSSTFLA-PT | 23 |
| SEQ_ID_NO_31 | MSPITQLL- | ---- | STS- | SSSAFLAAPL | 23 |
| SEQ_ID_NO_33 | MSSTHQL- | ---- | STS- | SSSTFLA-PS | 23 |
| SEQ_ID_NO_34 | MYSLMSS- | ---- | VSS- | SSSSFLG-QT | 21 |
| SEQ_ID_NO_35 | MAASPAA- | ---- | PS- | TVSSFVS-PS | 21 |
| SEQ_ID_NO_37 | MAAAPASSAA | AMAAAP- | GA- | ASSSFVS-SS | 28 |
| SEQ_ID_NO_39 | MAAAPAG- | AP- | AIT | ASSSFLA-SP | 21 |
| SEQ_ID_NO_41 | MAAAPAG- | AP- | AIT | ASSSFVS-SS | 21 |
| SEQ_ID_NO_42 | MSIPSAR- | LCTIVPA | TRNLSSSVSF | STATSLL-PK | 32 |

| | | | | | |
|---|---|---|---|---|---|
| SEQ_ID_NO_27 | SFNC-R- | -G- | QVSLP- | VKS- | V- | SICKCVAT | PE-AETAYKT | 54 |
| SEQ_ID_NO_29 | SFNSSR- | -TQ | SVSVP- | LKS- | I- | NIVKCVAT | PQEQQNAYKT | 58 |
| SEQ_ID_NO_31 | AFKA-R- | -NQ | NVSIA-SKT- | P- | SICTCAAA | PQEQKTVYKT | 57 |
| SEQ_ID_NO_33 | NFNL-R- | -TR | NACLPMAKR- | V- | NTCKCVAT | PQE-KLEYKT | 57 |
| SEQ_ID_NO_34 | HFDSL- | -NP | NACLP-TKD- | SL- | WCKCVAT | PSTETTAHTT | 55 |
| SEQ_ID_NO_35 | SFSSVKASKP | DRLRP- | ARRA | AAVNVRCVSS | PPATETSFKT | 60 |
| SEQ_ID_NO_37 | PCSL-RVSKT | SPRRP- | TGRV | S-HKISCVSS | PPAAETSYKT | 65 |
| SEQ_ID_NO_39 | PFAL-KASTT | SHRRP- | AGRV | S-VNIRCVSS | PPAVDTSYKT | 58 |
| SEQ_ID_NO_41 | PFCL-KASMT | SQRRP- | AGRV | S-IVIRCVSS | PPAVDTSFKT | 58 |
| SEQ_ID_NO_42 | ---- | -VSVTRGAS- | V- | SLIRCIAE | PA-EKTTYTT | 58 |

| | | | | | |
|---|---|---|---|---|---|
| SEQ_ID_NO_27 | GVNRNPNMGK | LQAGYLFPEI | ARRRSAHLLK | YPDAKVISLG | 94 |
| SEQ_ID_NO_29 | KVSRNANIAK | LQAGYLFPEV | ARRRAAHLLK | YPNAQVISLG | 98 |
| SEQ_ID_NO_31 | QVSRNANIAK | LQAGYLFPEV | ARRRNAHMLK | YPDAKVISLG | 97 |
| SEQ_ID_NO_33 | KVSRNSNMSK | LQAGYLFPEI | ARRRSAHLLK | YPDAQVISLG | 97 |
| SEQ_ID_NO_34 | KVSRNANMAK | LQAGYLFPEI | ARRRSAHMLK | YPDAKIISLG | 95 |
| SEQ_ID_NO_35 | KVPRNANMAK | LQAGYLFPEI | ARRRAAHLLK | FPDAKIISLG | 100 |
| SEQ_ID_NO_37 | SVPRNANMAK | LQAGYLFPEI | ARRRAAHLLK | YPDAKIISLG | 105 |
| SEQ_ID_NO_39 | NVPRNANMAK | LQAGYLFPEI | ARRRAAHLLK | FPDAKIISLG | 98 |
| SEQ_ID_NO_41 | NVPRNANMAK | LQAGYLFPEI | ARRRAAHLLK | YPDAKIISLG | 98 |
| SEQ_ID_NO_42 | SVNRNANIAK | LQAGYLFPEI | ARRRNAHIQR | YPDAKVISLG | 98 |

Figure 5B

| SEQ ID | | | | | | |
|---|---|---|---|---|---|---|
| SEQ_ID_NO_27 | GDTTEPI PE | VI TDAMSKRS | HALSTI EGYS | GYGAEQGEKP | 134 |
| SEQ_ID_NO_29 | GDTTEPI PD | VI TSAMAKRS | HALSTLEGYS | GYGAEQGEKA | 138 |
| SEQ_ID_NO_31 | GDTTEPI PE | VI TSAI AKRA | EALSTLEGYS | GYGPEQGEKP | 137 |
| SEQ_ID_NO_33 | GDTTEPI PE | VI TSAMAKKA | HELSTI EGYS | GYGAEQGEKP | 137 |
| SEQ_ID_NO_34 | GDTTEPI PE | VI TSGMAKKA | HALSTLEGYS | GYGAEQGAKP | 135 |
| SEQ_ID_NO_35 | GDTTEPI PD | VI TNAMAKRA | HALSTVDGYS | GYGAEQGEKQ | 140 |
| SEQ_ID_NO_37 | GDTTEPI PD | VI TNAMAKRA | HALSTI DGYS | GYGAEQGEKK | 145 |
| SEQ_ID_NO_39 | GDTTEPI PN | VI TNAMAERA | LALSTI DGYS | GYGAEQGEKK | 138 |
| SEQ_ID_NO_41 | GDTTEPI PN | VI TNAMAERA | HALSTI DGYS | GYGAEQGEKK | 138 |
| SEQ_ID_NO_42 | GDTTEPI PT | VI TGAMEARA | RALSTLEGYS | GYGAEQGEKP | 138 |

| SEQ ID | | | | | | |
|---|---|---|---|---|---|---|
| SEQ_ID_NO_27 | LRRAL ASTFY | SDLGI EEDDI | FVSDGAKCDI | SRLQI VFGSN | 174 |
| SEQ_ID_NO_29 | LRAAL ASTFY | RNLGI EDDDI | FVSDGAKCDI | SRLQVVFGSN | 178 |
| SEQ_ID_NO_31 | LRTAI ASTFY | SGLGI EEDDI | FVSDGAKCDI | SRLQMVFGAN | 177 |
| SEQ_ID_NO_33 | LRAAI AKTFY | GGLGI GDDDV | FVSDGAKCDI | SRLQVMFGSN | 177 |
| SEQ_ID_NO_34 | LRAAI ASTFY | GDLSI EESDI | FVSDGAKSDI | SRLQVMFGSN | 175 |
| SEQ_ID_NO_35 | LRAAI AATYY | ADLGI EETDI | FVSDGAKCDI | SRLQVLFGSN | 180 |
| SEQ_ID_NO_37 | LRSAI AATYY | VDLGI EDSDI | FVSDGAKCDI | SRLQVLFGSN | 185 |
| SEQ_ID_NO_39 | LRAAI AATYY | ADLGI EDSDI | FVSDGAKCDI | SRLQVLFGSN | 178 |
| SEQ_ID_NO_41 | LRAAI AATYY | ADLGI EDSDI | FVSDGAKCDI | SRLQVLFGSN | 178 |
| SEQ_ID_NO_42 | LRAGI GAAFY | ADLGI DETEI | FVSDGAKCDI | TRLQLVFGPN | 178 |

| SEQ ID | | | | | | |
|---|---|---|---|---|---|---|
| SEQ_ID_NO_27 | VKMAVQDPSY | PAYVDSSVI M | GQTGLFQKNV | EKFANI EYMR | 214 |
| SEQ_ID_NO_29 | VTMAVQDPSY | PAYVDSSVI M | GQTGQFQKDV | EKYGNI EYMR | 218 |
| SEQ_ID_NO_31 | VTMAVQDPSY | PAYVDSSVI M | GQTGQFQKDV | EKYGKI EYMR | 217 |
| SEQ_ID_NO_33 | VTI AVQDPSY | PAYVDSSVI M | GQTGQFNTDV | QKYGNI EYMR | 217 |
| SEQ_ID_NO_34 | VTMAVQDPSY | PAYVDLSVI L | GQTGQFQKDV | EKYGNI EYMK | 215 |
| SEQ_ID_NO_35 | VKI AVQDPSY | PAYVDSSVI M | GQTGLYQEDV | QKYGNI EYMR | 220 |
| SEQ_ID_NO_37 | VTI AVQDPSY | PAYVDSSVI M | SQTGLYQQDV | QKYGNI QYMR | 225 |
| SEQ_ID_NO_39 | VTI AVQDPSY | PAYVDSSVI M | GQTDLYQQDV | QKYGNI EYMR | 218 |
| SEQ_ID_NO_41 | VTI AVQDPSY | PAYVDSSVI M | GQTDLYQQDV | QKYGNI EYMR | 218 |
| SEQ_ID_NO_42 | VTMAAQDPSY | PAYVDTSVMM | GQTGLFQSDS | QQYSKI QYMK | 218 |

Figure 5C

| SEQ_ID_NO | | | | | | |
|---|---|---|---|---|---|---|
| SEQ_ID_NO_27 | CNPENGFFPD | LSSI SRPDI | | FFCSPNNPTG | AVATREQLTQ | 254 |
| SEQ_ID_NO_29 | CTPENGFFPD | LSKVARTDI | | FFCSPNNPTG | AAATREQLTR | 258 |
| SEQ_ID_NO_31 | CTPENGFFPD | LSKVSRTDI | | FFCSPNNPTG | SAATREQLTQ | 257 |
| SEQ_ID_NO_33 | CTPENGFFPD | LSTVGRTDI | | FFCSPNNPTG | AAATREQLTQ | 257 |
| SEQ_ID_NO_34 | CNPENGFFPD | LSTVSRTDI | | FFCSPYNPTG | NAATREQLTR | 255 |
| SEQ_ID_NO_35 | CSPENGFFPD | LSSVPRTDI | | FFCSPNNPTG | AAASRDQLTR | 260 |
| SEQ_ID_NO_37 | CNPENGFFPD | LSTI PRTDI | | FFCSPNNPTG | AAASRDQLTK | 265 |
| SEQ_ID_NO_39 | CSPENGFFPD | LSTVPRTDI | | FFCSPNNPTG | AAASRDQLTR | 258 |
| SEQ_ID_NO_41 | CGPENGDFFPD | LSTVPRTDI | | FFCSPNNPTG | AAASRKQLTK | 258 |
| SEQ_ID_NO_42 | CTPENDFFPD | LSSTPRTDI | | FFCSPNNPTG | ASASRKQLEE | 258 |

| SEQ_ID_NO | | | | | | |
|---|---|---|---|---|---|---|
| SEQ_ID_NO_27 | LVQFAKDNGS | VI HDSAYAM | YI SGDNPRSI | FEI PGAKEVA | 294 |
| SEQ_ID_NO_29 | LVKFAKDNGS | I-VYDSAYAM | YMSDDNPRSI | FEI PGAKEVA | 298 |
| SEQ_ID_NO_31 | LVQFAKDNGS | --VYDSAYAM | YMSDDNPRSI | FEI PGAKEVA | 297 |
| SEQ_ID_NO_33 | LVEFAKKNGS | --VYDSAYAM | YMSDDNPRSI | FEI PGAEEVA | 297 |
| SEQ_ID_NO_34 | LVQFAKDNGS | L-VYDSGYAM | YI SDDSPRSI | FEI PGAKEVA | 295 |
| SEQ_ID_NO_35 | LVKFAKDNGS | --VYDSAYAM | YI SDDSPKSI | FEI PGAKEVA | 300 |
| SEQ_ID_NO_37 | LVKFAKDNGS | --VYDSAYAM | YI SDDSPKSI | FEI PGAKEVA | 305 |
| SEQ_ID_NO_39 | LVKFAKDNGS | --VYDSAYAM | YI SDDSPKSI | FEI PGAREVA | 298 |
| SEQ_ID_NO_41 | LVKFAKKNGS | --VYDSAYAM | YI SDDSPKSI | FEI PGAKEVA | 298 |
| SEQ_ID_NO_42 | LVAFAKKNGS | --VYDSAYAI | YTSDDSPKSI | YEI PGAKECA | 298 |

| SEQ_ID_NO | | | | | | |
|---|---|---|---|---|---|---|
| SEQ_ID_NO_27 | ETSSFSKYA | GFTGVRLGWT | VVPKQLLFSD | GFPVAKDFNR | 334 |
| SEQ_ID_NO_29 | ETASFSKYA | GFTGVRLGWT | VI PKQLLFSD | GFPVAKDFNR | 338 |
| SEQ_ID_NO_31 | ETSSFSKYA | GFTGVRLGWT | VVPKQLLYSD | GFPVVKDFNR | 337 |
| SEQ_ID_NO_33 | LETSFSKYA | GFTGVRLGWT | VI PKKLLYSD | GFPVAKDFNR | 337 |
| SEQ_ID_NO_34 | METASFSKYA | GFTGVRLGWT | VVPKELLFSD | GFPVAKDFNR | 335 |
| SEQ_ID_NO_35 | EVSSFSKYA | GFTGVRLGWT | VVPKELLFSD | GHPVAKDFNR | 340 |
| SEQ_ID_NO_37 | ETASFSKYA | GFTGVRLGWT | VVPKELLFSD | GHPVAKDFNR | 345 |
| SEQ_ID_NO_39 | ETASFSKYA | GFTGVRXGWT | VVPKELLFSD | GHPVAKDFNR | 338 |
| SEQ_ID_NO_41 | ETASFSKYA | GFTGVRLGWT | VVPKELLFSD | GHPVAKDFNR | 338 |
| SEQ_ID_NO_42 | ETASFSKYA | GFTGVRLGWT | VVPKALKFAD | GHPVHTDFNR | 338 |

Figure 5D

| SEQ_ID_NO | | | | | | |
|---|---|---|---|---|---|---|
| SEQ_ID_NO_27 | IVCTCFNGAS | NISQAGGLAC | LSPEGLKAMR | DVIGFYKENT | 374 |
| SEQ_ID_NO_29 | IVCTCFNGAS | NIAQAGGLAC | LSSEGLEAMQ | EVIGFYKENT | 378 |
| SEQ_ID_NO_31 | VVCTSFNGAS | NICQAGGRAC | LSPEGLKAMS | EVIGFYKENS | 377 |
| SEQ_ID_NO_33 | ILCTCFNGAS | NISQAGALAC | LTPEGLEAMH | KVIGFYKENT | 377 |
| SEQ_ID_NO_34 | ECTTFNAAS | NISQASGLAC | LSPEGLEAMH | KLVGFYKENT | 375 |
| SEQ_ID_NO_35 | IVCTCFNGAS | NISQAGGLGC | LSPEGLKAMS | DVVGFYKENT | 380 |
| SEQ_ID_NO_37 | IVCTCFNGAS | NIAQAGGLAC | LSPEGLKAMH | DVVGFYKENT | 385 |
| SEQ_ID_NO_39 | IVCTCFNGAS | NISQAGGLAC | LSPEGLKAMQ | DVVGFYKENT | 378 |
| SEQ_ID_NO_41 | IVCTCFNGAS | NIAQAGGLAC | LSPDGLKAMQ | DVVGFYKENT | 378 |
| SEQ_ID_NO_42 | VMTTCFNGAS | NVAQAGGLAC | VSSEGLKAMH | ETVKFYKENT | 378 |

| SEQ_ID_NO | | | | | | |
|---|---|---|---|---|---|---|
| SEQ_ID_NO_27 | NIMETFDSL | GFKVYGGKDA | PYVWHFPGR | SSWDVFAEIL | 414 |
| SEQ_ID_NO_29 | KIVETFNSL | GFKVYGGKNA | PYVWHFPGR | SSWDVFSEIL | 418 |
| SEQ_ID_NO_31 | NIMDTFNSL | GFNVYGGKNA | PYVWHFPGR | SSWDVFSEIL | 417 |
| SEQ_ID_NO_33 | NILDTFTSL | GYDVYGGKNA | PYVWHFPGR | SSWDVFAEIL | 417 |
| SEQ_ID_NO_34 | NIMETFTSL | GFSVYGGKNA | PYVWHFPGR | SSWDVFAEIL | 415 |
| SEQ_ID_NO_35 | KIVDTFTSL | GFNVYGAKNA | PYVWHFPNQ | SSWDVFAEIL | 420 |
| SEQ_ID_NO_37 | EILVDTFTSL | GFNVYGAKNA | PYVWHFPGQ | NSWDVFAEIL | 425 |
| SEQ_ID_NO_39 | EILVDTFTSL | GFNVYGAKNA | PYVWHFPGR | NSWDVFAEIL | 418 |
| SEQ_ID_NO_41 | EIXVETFTSL | GFNVYGAKNA | PYVWHFPGR | NSWDVFAEIL | 418 |
| SEQ_ID_NO_42 | KILVETFESL | GFKTFGGKNA | PYVWQFPGK | SSWDVFSEIL | 418 |

| SEQ_ID_NO | | | | | | |
|---|---|---|---|---|---|---|
| SEQ_ID_NO_27 | EKTHVVTTPG | SGFGPGGEGF | IRVSAFGHRE | NVLEACRRFK | 454 |
| SEQ_ID_NO_29 | EKTHIVTTPG | SGFGPGGEGF | IRVSAFGHRE | NVLEACRRFK | 458 |
| SEQ_ID_NO_31 | EKTHVVTTPG | SGFGPGGEGF | VRVSAFGHRE | NVLEACRRFK | 457 |
| SEQ_ID_NO_33 | EKTHVVTTPG | SGFGPGGEGF | IRVCAFSHRG | NVLEACKRFK | 457 |
| SEQ_ID_NO_34 | EKTHVVTTPG | SGFGPAGDGF | VRVSAFGHRE | NVLEACRRFK | 455 |
| SEQ_ID_NO_35 | EKAHVVTTPG | SGFGPGGEGF | VRVSAFGHRE | NIIEAARRLK | 460 |
| SEQ_ID_NO_37 | EKANVVTTPG | SGFGPGGEGF | VRVSAFGHRD | NIIEAARRLK | 465 |
| SEQ_ID_NO_39 | EKANVVTTPG | SGFGPGGEGF | VRVSAFGHRE | NIIEAARRLK | 458 |
| SEQ_ID_NO_41 | EKANVVTTPG | TGFGPGGEGF | VRVSAFGHRE | NIIEAARRXK | 458 |
| SEQ_ID_NO_42 | EQTHIVTTPG | SGFGPGGEGF | IRASAFGHRE | NILEASRRLK | 458 |

Figure 5E

| | | | |
|---|---|---|---|
| SEQ_ID_NO_27 | QLY | --- | K | 458 |
| SEQ_ID_NO_29 | QLY | --- | N | 462 |
| SEQ_ID_NO_31 | QLY | --- | N | 461 |
| SEQ_ID_NO_33 | QLY | --- | K | 461 |
| SEQ_ID_NO_34 | RLY | --- | K | 459 |
| SEQ_ID_NO_35 | QLY | --- | K | 464 |
| SEQ_ID_NO_37 | QLY | --- | K | 469 |
| SEQ_ID_NO_39 | QLY | --- | K | 462 |
| SEQ_ID_NO_41 | QLY | --- | K | 462 |
| SEQ_ID_NO_42 | EYF | GS | KK | 465 |

Figure 6A

| | | | | | | | |
|---|---|---|---|---|---|---|---|
| SEQ_ID_NO_209 | MDQKV- | - - - | - - - | - - - | - - - | - - - | 5 |
| SEQ_ID_NO_211 | MACLN- | -CK- | - - - | - - - | - - - | K | 19 |
| SEQ_ID_NO_212 | MYL- | - - - | EEGS | VQG- | KLV- | - - - | 3 |
| SEQ_ID_NO_213 | MVN- | - - - | - - - | - - - | - - - | - - - | 3 |
| SEQ_ID_NO_214 | MAPTA | - - - | - - - | - - - | V- | DS | 8 |
| SEQ_ID_NO_216 | MDPTT | - - - | - - - | - - - | V- | ES | 8 |
| SEQ_ID_NO_218 | MGEV- | - - - | - - - | - - - | - - - | - - - | 4 |
| SEQ_ID_NO_219 | MNAVG | - - - | - - - | - - - | - - - | G | 6 |
| SEQ_ID_NO_220 | MGVEG- | E- | GS | VET- | ALLEE | GSI SSVQT GK | 26 |
| SEQ_ID_NO_221 | MGSLE | ER- | LL | VED- | EPV | KN | 17 |
| SEQ_ID_NO_222 | MKYLF | S- | - - - | KNG- | GLL | ED | 14 |
| SEQ_ID_NO_223 | MGSVE | DD- | SSR | LEE- | ALI | QD | 18 |
| SEQ_ID_NO_225 | MKMR-A | VV- | EGGE | MSAPTPTP | - - - | KQ | 22 |
| SEQ_ID_NO_227 | MEPG- | CN- | SVNS | VN- | V- | EA | 16 |
| SEQ_ID_NO_229 | MDATT | - - - | - - - | - - - | - - - | DS | 8 |
| SEQ_ID_NO_230 | MSANE | -GDL | KMRVI AM GGE | AASE-R- | R- | AAE | 27 |
| SEQ_ID_NO_231 | MDQKV | - - - | - - - | - - - | - - - | - - - | 5 |

Figure 6B

| SEQ_ID_NO | | | | | |
|---|---|---|---|---|---|
| SEQ_ID_NO_209 | RQFEVCTQDG | SVDRHGNPAI | RANTGKWLTA | LILVNQGLA | 45 |
| SEQ_ID_NO_211 | KEQEVCTRDG | SVDRHGDPAI | RGRTGTWFAG | LILVNQGLA | 59 |
| SEQ_ID_NO_212 | NPLSECTFDG | SVDRHGHPAV | RARTGNWVTA | LILVNQGLA | 43 |
| SEQ_ID_NO_213 | KELEVCTLDG | SIDSHGHPAV | RERTGTWFAG | LILVNYGLV | 43 |
| SEQ_ID_NO_214 | KRISDITEDG | SMDRRGNPAV | KAKTGNWRSS | LLLVNYGLV | 48 |
| SEQ_ID_NO_216 | KWSPTTEDG  | SMDRRGNPAA | KAASGRWRSA | LLLANYGLV | 48 |
| SEQ_ID_NO_218 | -AAELYTQDG | TIDLKGNPAL | KKDTGNWRAC | PYILANECCE | 43 |
| SEQ_ID_NO_219 | APDSEYPQDG | TVDLRGNPVL | KANTGGWKAC | PYILGNECCE | 46 |
| SEQ_ID_NO_220 | ASEDEYTGDG | SVDFWGRPSV | KENTGNWRAC | PFILGNECCE | 66 |
| SEQ_ID_NO_221 | DGIGLYTGDG | SVDIDGKPVL | KENTGKWRAC | PFILGTECCE | 57 |
| SEQ_ID_NO_222 | ENSGLYTRDG | SVDIKGNPVL | KSETGNWRAC | PFILGNECCE | 54 |
| SEQ_ID_NO_223 | EESKLYTLDG | SVDFKGRPVL | KKNTGNWKAC | PFILGNECCE | 58 |
| SEQ_ID_NO_225 | DKCCEYTLDG | SVDIKGRPAV | KGKSGGWLAG | LILVNQGLA | 62 |
| SEQ_ID_NO_227 | TEKKVTGGNG | SYTEQSDTSY | KKIKGGVKTA | LLLANQALA | 56 |
| SEQ_ID_NO_229 | KWSPATEDG  | SMDRRGNPAV | KTTTGRWRSA | LLLANYGLA | 48 |
| SEQ_ID_NO_230 | EKLCEYTLDG | SVDIKGRPAV | KGKSGGWLAG | GLILVNQGLA | 67 |
| SEQ_ID_NO_231 | RHTEVCTQDG | SVDRHGNPAI | RAKTGKWLTA | LILVNQGLA | 45 |

Figure 6C

| SEQ ID | Sequence | # |
|---|---|---|
| SEQ_ID_NO_209 | TLAFFGVGVN LVL FLTRVM GQDNAEAANN VSKWTGTVYI | 84 |
| SEQ_ID_NO_211 | TLAFFGVGVN LVL FLTRVL GQDNAEAANN VSKWTGTVYI | 98 |
| SEQ_ID_NO_212 | TLAFFGVGVN LVL FLTRVL GQDNATAANN VSKWTGTVYI | 82 |
| SEQ_ID_NO_213 | TLAFFGVGVN LVL FLTRVM GQDNADAANN VSKWTGTVYI | 82 |
| SEQ_ID_NO_214 | TCAFFGVGVN LVV FLRRVL HQDNAEAANN ISKWTGTVYI | 87 |
| SEQ_ID_NO_216 | TCAFFGVGVN LVV FLRRVL HQDNAEAANN ISKWTGTVYI | 87 |
| SEQ_ID_NO_218 | RLAYYGMST LVN- FMKDRM GMANAAAANN VTNWGGTCYI | 82 |
| SEQ_ID_NO_219 | RLAYYGI ATN LVT YLSHEL HQNPSTAANN VTNWSGTCYI | 85 |
| SEQ_ID_NO_220 | RLAYYGI NTN LVT YLTKRL HQGNASAARN VTTWAGTCYL | 105 |
| SEQ_ID_NO_221 | RLAYYGI ATN LVT YLTSIKL HEGNASAARN VTTWSGTCYL | 96 |
| SEQ_ID_NO_222 | RLAYYGI AAN LVT YLTKKL HEGNVSAARN VTTWQGTCYL | 93 |
| SEQ_ID_NO_223 | RLAYYGI ATN LVT VKPILL HEGNVSAARN VTTWQGTCYL | 98 |
| SEQ_ID_NO_225 | TLAFFGVNVN LVL FLTRVL GQSNEDAANN VSKWTGTVYM | 101 |
| SEQ_ID_NO_227 | TLAFFGVGVN LVL FLRRVL RQDSAEAANN VSKWTGTVYI | 95 |
| SEQ_ID_NO_229 | TCAFFGVGVN LVV FLTRLV HQGNAEAANS ISKWTGTVYI | 87 |
| SEQ_ID_NO_230 | TMAFFGVNVN LVL FLTRLV QQSNGDAANN VSKWTGTVYM | 106 |
| SEQ_ID_NO_231 | TLAFFGVGVN LVL FLTRVM GQDNAEAANN VSKWTGTVYI | 84 |

Figure 6D

| SEQ_ID_NO | | | | | |
|---|---|---|---|---|---|
| SEQ_ID_NO_209 | FSLLGAFLSD | SYWGRYKTCA | FQASFVAGL | MMLSLSTGAL F | 124 |
| SEQ_ID_NO_211 | FSLLGAFLSD | SYWGRYKTCA | FQAIFVTGL | VLLSLSSYLF | 138 |
| SEQ_ID_NO_212 | FSLLGAFLSD | SYWGRYKTCA | FQVIFVGL | VLLSLSSYIF | 122 |
| SEQ_ID_NO_213 | FSLLGAFLSD | SYWGRYITCA | FQVIFVVGL | VALSLTSYIF | 122 |
| SEQ_ID_NO_214 | FSLIGAFMSD | SYWGRYITCA | FQMIYVTGL | VILSLASWFL | 127 |
| SEQ_ID_NO_216 | FSLIGAFLSD | SYWGRYVTCA | FQIIYVTGL | VILSLASWFL | 127 |
| SEQ_ID_NO_218 | TPLIGAFLAD | AYLGRFWTIA | SFMIYIFGL | GLLTMATSVH | 122 |
| SEQ_ID_NO_219 | TTLGAFLAD | AYLGRFWTIV | VFSIIYFLGM | VLLTLSAALP | 125 |
| SEQ_ID_NO_220 | TPLFGAVLAD | AYWGRYWTIA | AFSTIYFIGM | ATLTLSASVS | 145 |
| SEQ_ID_NO_221 | APLIGAVLAD | SYWGRYWTIA | VFSIIYFIGM | GTLTLSASVA | 136 |
| SEQ_ID_NO_222 | TPLIGAVLAD | AYWGRYWTIA | TFSTIYFIGM | CTLTLSASVP | 133 |
| SEQ_ID_NO_223 | APLIGAVLAD | SYWGRYWTIA | FSMIYFIGM | GTLTLSASIP | 138 |
| SEQ_ID_NO_225 | FSLIGAFLSD | SYWGRYKTCA | FQAIFVLGL | ALLSVSSHLY | 141 |
| SEQ_ID_NO_227 | FSLIGAFLSD | SYWGRYLTCA | FQFIFVVGL | GMLSLSSWRF | 135 |
| SEQ_ID_NO_229 | FSLIGAFLSD | SYWGRYVTCA | VFQIIYVMGL | VVLSLASWLL | 127 |
| SEQ_ID_NO_230 | FSLLGAFLSD | SYWGRYKTCA | FQAIFVLGL | GLLSLSSRLY | 146 |
| SEQ_ID_NO_231 | FSLLGAFLSD | SYWGRYKTCA | FQASFVAGL | VMLSLSTGAL | 124 |

Figure 6E

| | | | | |
|---|---|---|---|---|
| SEQ_ID_NO_209 | LLEPSGCGVE | DSPCKPHSTF | KTVLFYLSVY | LI ALGYGGYQ | 164 |
| SEQ_ID_NO_211 | LLKPRGCGDE | HSPCGSHSTY | QNVFFYFSI Y | LVALGNGGYQ | 178 |
| SEQ_ID_NO_212 | LLKPNGCGDK | EFPCGSHSTF | EI SFFYLSI Y | LI ALGNGGYQ | 162 |
| SEQ_ID_NO_213 | LLKPNGCGSK | ELPCGTHSSY | ETTLFYVSI Y | LVALGNGGYQ | 162 |
| SEQ_ID_NO_214 | LVKPTGCGAA | GEHCDAPSSA | GVALFYLSTY | MI AFGNGGYQ | 167 |
| SEQ_ID_NO_216 | LVKPSGCGGV | DARCDEPSAP | GVALFYLSTY | MI AFGNGGYQ | 167 |
| SEQ_ID_NO_218 | GLVPACASK- | -GVCDPFTPG | QSAAVFI ALY | LI ALGTGGI K | 159 |
| SEQ_ID_NO_219 | SLKPPSGEG- | -VV-ALSST | QLAVFYLALY | LI ALGTGGI K | 160 |
| SEQ_ID_NO_220 | SLKPPSCLG- | SDCPTANLA | QYGVFFLGLY | LI ALGTGGI K | 183 |
| SEQ_ID_NO_221 | AFKPSPCVG- | SVCPAATPA | QYAVFFFCGLY | LI ALGTGGI K | 174 |
| SEQ_ID_NO_222 | AFKPPQCVG- | SVCPSASPA | QYAI FFFGLY | LI ALGTGGI K | 171 |
| SEQ_ID_NO_223 | ALKPAECLG- | AVCPPATPA | QYAVFFI GLY | LI ALGTGGI K | 176 |
| SEQ_ID_NO_225 | LI RPDGCGME | HAPCGPHSGK | ELGI FYI ALY | MI AFGNGGYQ | 181 |
| SEQ_ID_NO_227 | LI KPVGCGNE | ETTCLEPSSV | GVGI FYLSI Y | LVAFGYGGHQ | 175 |
| SEQ_ID_NO_229 | LVKPSGCGGV | KAHCDGPSAP | GVALFYLSTY | MI AFGNGGYQ | 167 |
| SEQ_ID_NO_230 | LI RPVGCGTE | HTPCASHSGT | EMGI FYI ALY | MI AFGNGGYQ | 186 |
| SEQ_ID_NO_231 | LLEPSGCGVE | ESPCKPHSTV | KTVI FYLSVY | LI ALGYGGYQ | 164 |

Figure 6F

| SEQ_ID | | | | | | Length |
|---|---|---|---|---|---|---|
| SEQ_ID_NO_209 | PNI ATFGADQ | FDAEDSVEGH | SKI AFFSYFY | LALNLGSLFS | | 204 |
| SEQ_ID_NO_211 | PNI ATFGADQ | FDEEDPKEGH | SKI AFFSYFY | LALNLGSLFS | | 218 |
| SEQ_ID_NO_212 | PNI ATFGADQ | FDEDNPKE[S]H | SKVAFFSYFY | LALNLGSLFS | | 202 |
| SEQ_ID_NO_213 | PTI ATFGADQ | FDESDP[SE]QH | SKI AFFSYFY | LALNI GSLFS | | 202 |
| SEQ_ID_NO_214 | PSI ATFGSDQ | FDETDPREAR | SKVAFFSYFY | LALNVGSLFS | | 207 |
| SEQ_ID_NO_216 | PSI ATFGSDQ | FDETDPKEAR | SKVAFFSYFY | LALNVGSLFS | | 207 |
| SEQ_ID_NO_218 | PCVSSFGADQ | FDEH[HD]VERK | SKSSFFNWFY | FSI NI GALVA | | 199 |
| SEQ_ID_NO_219 | PCVSSFGADQ | FDEN[DV]KEKK | R[K]SSFFNWFY | [FT]NI GALI A | | 200 |
| SEQ_ID_NO_220 | PCVSSFGADQ | FDDTDPKEKK | [K]KGSFFNWFY | FSI NVGALVS | | 223 |
| SEQ_ID_NO_221 | PCVSSFGADQ | FDDTDPVERV | [Q]KGSFFNWFY | FSI NI GALI S | | 214 |
| SEQ_ID_NO_222 | PCVSSFGADQ | FDDTDPKERV | [K]KGSFFNWFY | FSI NI GALI S | | 211 |
| SEQ_ID_NO_223 | PCVSSFGADQ | FDDTDSRERV | SKVSFFSYFY | FSI NI GALI S | | 216 |
| SEQ_ID_NO_225 | PNI AT[L]GADQ | FDEDDPAEAH | A REAFFSYFY | FALNLGSLFS | | 221 |
| SEQ_ID_NO_227 | PTLATFGADQ | FDE[KN][EK]QKN | SKVAFFSYFY | LALNVGSLFS | | 215 |
| SEQ_ID_NO_229 | PSI ATFGSDQ | FDETDPEEAR | SKVSFFSYFY | [MA]LNLGSLFS | | 207 |
| SEQ_ID_NO_230 | PNI ATFGADQ | FDEEDPAEAH | SKI AFFSYFY | LALNLGSLFS | | 226 |
| SEQ_ID_NO_231 | PNI ATFGSDQ | FDADDSVEGH | SKI AFFSYFY | LALNLGSLLS | | 204 |

Figure 6G

| SEQ_ID | | | | | | |
|---|---|---|---|---|---|---|
| SEQ_ID_NO_209 | NTVLGYFEDQ | GEWPLGFWAS | AGSAFAGLVL | FLIGTPKYRH | 244 |
| SEQ_ID_NO_211 | NTILGYFEDR | GMWALGFWAS | AGSALLALVL | FLLGTPRYRH | 258 |
| SEQ_ID_NO_212 | NTILGYFEDG | GRWLGFWAS | SASALLALIL | FLFGIPRYRH | 242 |
| SEQ_ID_NO_213 | NTIDYFEDD | GLWTLGFCVS | AGSAALALVL | FLCGTSKYRY | 242 |
| SEQ_ID_NO_214 | NTVLVYYEDE | GRWMGFWVS | AAAAAMALVL | FLLGTPNYRH | 247 |
| SEQ_ID_NO_216 | NTVLVYYEDS | GRWMGFWVS | AAAALALVL | FLLGTPNYRH | 247 |
| SEQ_ID_NO_218 | SSVLVYVQTH | VGWSWGFGIP | AVVMAIAVGS | FLIGSPLYRH | 239 |
| SEQ_ID_NO_219 | SSALVYIQEN | VGWGWGFGIP | AVAMGIAIVS | FFVGTPLYRH | 240 |
| SEQ_ID_NO_220 | SSVLVWQDN | VGWGWGFGIP | TLFMGLAIGS | FFSGTPLYRH | 263 |
| SEQ_ID_NO_221 | SSFLVMQEN | AGWGLGFGIP | TLFMGVAILS | FFSGTPLYRF | 254 |
| SEQ_ID_NO_222 | SSLIVMQEN | AGWGLGFGIP | AVFMGIAIAS | FFFGTPLYRF | 251 |
| SEQ_ID_NO_223 | SSFIVMQEN | AGWGLGFGIP | ALFMGLAIGS | FFLGTPLYRF | 256 |
| SEQ_ID_NO_225 | NTFLSYLEDK | GSWALGFWAS | TAAAATALLL | FLSGTLRYRY | 261 |
| SEQ_ID_NO_227 | NTILVYYEDS | GMWTMGFLVS | LASAVIALVL | YLAGYRKYRY | 255 |
| SEQ_ID_NO_229 | NTVLVYYEDS | GRWMGFWVS | AAAAATALVL | FLLGTPGYRH | 247 |
| SEQ_ID_NO_230 | NTFLSYLQDH | GKWLGFWAS | TAAAATALLL | FLSGTPQYRH | 266 |
| SEQ_ID_NO_231 | NTVLGYFEDQ | GAWPLGFWAS | AGSAFAGLVL | FLAGTPKYRH | 244 |

Figure 6H

| SEQ ID | Sequence | Pos |
|---|---|---|
| SEQ_ID_NO_209 | FTPRESPWSR FCQVLVAATR KAKID-V--HH EELNLYDS- | 280 |
| SEQ_ID_NO_211 | FTPKGNPLSR CCQVMVAATR KWKVQRM-PN QGDDQFESD- | 296 |
| SEQ_ID_NO_212 | FKPSGNPLSR FCRVVVAATR KWKVE-M--PP EGEDLYEVD- | 279 |
| SEQ_ID_NO_213 | FKPVGNPLPR FCQVFVAATR KWKVQ-M--FD GEDKLHEVE- | 279 |
| SEQ_ID_NO_214 | FKPTGNPLTR LAQVFVAAFR KWRAE-V--PR SE-LLHEVD- | 283 |
| SEQ_ID_NO_216 | FKPSGNPLTR VAQVFVAALR KWHAE-V--PR EE-FLHEVE- | 283 |
| SEQ_ID_NO_218 | QRPGGSPLTR LAQVLVAATR KLGV----PV DGSALYETA- | 274 |
| SEQ_ID_NO_219 | QKPGGSPITR LAQVLVAATR KLSMK-V--QP NGKHLYEAD- | 277 |
| SEQ_ID_NO_220 | QKPGGSPVTR MCQVVVASLR KLRKT-V--PL DHSHLYEVQ- | 300 |
| SEQ_ID_NO_221 | QKPGGSPLMR MCQVFVASFR KWNLD-V--PQ DSSLLFELP- | 291 |
| SEQ_ID_NO_222 | QKPGGSPLTR MCQVLVAVFH KWNLS-V--PD DSTLLYETP- | 288 |
| SEQ_ID_NO_223 | QKPGGSPLTR MCQVVAASFR KRNLT-ASTT PE DSSLLYETP- | 293 |
| SEQ_ID_NO_225 | FQPGGNPIGR LCQVAIAASR KWKAG----PA GVVSLYEGD- | 299 |
| SEQ_ID_NO_227 | VKGYGNPVLR VVQVFVATVR KWKVG-V--PR KEHQLYEVD- | 291 |
| SEQ_ID_NO_229 | FKPSGNPLTR VAQVFVAALR KWRAE-V--PR GE-LLHEVVE | 284 |
| SEQ_ID_NO_230 | AQPCGNPMAS LCQVASAACR NMKSG-GVSP DVEILYEGD- | 304 |
| SEQ_ID_NO_231 | FKPRESPWSR FCQVLVASTR KAKID-V--NY DDMNLYDS- | 280 |

| SEQ ID | Sequence | | | | End |
|---|---|---|---|---|---|
| SEQ_ID_NO_209 | - - - GSKYDPW | RLCSVTQVEE | VKCVLRLLPI | WLCTI LYSVV | 353 |
| SEQ_ID_NO_211 | - - - NRLHDPW | RVCTVNQVEE | FKCILRLLPI | WLCTI LYSVV | 368 |
| SEQ_ID_NO_212 | EDKESRSPW | RICTVTQVEE | VKCILRLLPI | WLCTI LYSVV | 352 |
| SEQ_ID_NO_213 | MEENKCSPW | FLSTVTQVEE | VKCILRLLPI | WLCTI LFSVV | 350 |
| SEQ_ID_NO_214 | - - - ENMQDPW | RLCTVTQVEE | VKCILKMLPI | WLCTI VYSVV | 355 |
| SEQ_ID_NO_216 | - - - EKMKDPW | RLCTVTQVEE | VKCILKMLPI | WLCTI VYSVV | 355 |
| SEQ_ID_NO_218 | - - - - TGPSPW | RLTSVTQVEE | LKSVVRLLPI | WASGI VFATV | 344 |
| SEQ_ID_NO_219 | - - - GTRPSGW | RLCTVTQVEE | VKIVMRLLPI | WASGI VFATV | 348 |
| SEQ_ID_NO_220 | - - - GGFSNPW | RLCTVTQVEE | MKILLRMFPI | WATGI VFAAV | 371 |
| SEQ_ID_NO_221 | - - - GDLTNPW | RLCTVTQVEE | LKILIRMFPI | WATGI VFSAV | 362 |
| SEQ_ID_NO_222 | - - - GDYSNAW | RLCTVTQVEE | LKILIRMFPV | WATGI VFSAV | 359 |
| SEQ_ID_NO_223 | - - - GDYSNLW | RLCTVTQVEE | LKILIRMFPI | WATGI VFSAV | 364 |
| SEQ_ID_NO_225 | - - - GARDPW | KLCTVTQVEE | VKSILRLLPI | WLCTI LYSVV | 367 |
| SEQ_ID_NO_227 | - - - NLKNHW | RLCTVTQVEE | AKCVLRMLPV | WLCTI VYSVV | 360 |
| SEQ_ID_NO_229 | - - - - EEGPW | RLCTVTQVEE | VKCILRMLPI | WLCTI LYSVV | 352 |
| SEQ_ID_NO_230 | ATCSKTRDQW | RLCTVTQVEQ | VKSILRILPI | WWCTI VYSVV | 377 |
| SEQ_ID_NO_231 | - - - GSAYDPW | RLCSVTQVEE | VKCVLRLLPI | WLCTI LYSVV | 353 |

Figure 6K

| SEQ ID | Sequence | Pos |
|---|---|---|
| SEQ_ID_NO_209 | FTQMASLFVV QGAAMK--TN ----I K- FRI PA SSMSSFDI LS | 389 |
| SEQ_ID_NO_211 | FTQMASLFVE QGADMK--TT ----S- FHI PP ASMSSFDI LS | 404 |
| SEQ_ID_NO_212 | FSQMASLFVE QGAAMK--TT ----L-L- FHI PP ASMSSFDI VS | 388 |
| SEQ_ID_NO_213 | FTQMASLFVE QGAAME--TK ----S- FHI PP ASMSVFDI LS | 386 |
| SEQ_ID_NO_214 | FTQMASLFVE QGTTMN--TN ----G- FHVPA ASMSLFDI LS | 391 |
| SEQ_ID_NO_216 | FTQMASLFVE QGATMN--TN ----G- FHFPA ASMSLFDTLS | 391 |
| SEQ_ID_NO_218 | YGQMSTMFVL QGNTLD-AS MGPK- FKI PS ASLSI FDTI -S | 381 |
| SEQ_ID_NO_219 | YSQMSTMFVQ QGALMN-VS MG-K- ANI PS ASLSVFDVVS | 384 |
| SEQ_ID_NO_220 | YSQI STMFVE QGMTLD--TS ----G- SRFHI PP ASLSTFDVLS | 408 |
| SEQ_ID_NO_221 | YAQMSTMFVE QGMVMD--TT ----VG- FT I PP ASLSTFDTI -S | 398 |
| SEQ_ID_NO_222 | YAQMSTMFVE QGMVMD--TS ----VG- FKI PA ASLSTFDVI -S | 395 |
| SEQ_ID_NO_223 | YAQMSTMFVE QGTMMD--TS FS-G- FSVPP ASMSAFDI LA | 400 |
| SEQ_ID_NO_225 | FTQMASLFVE QGAAMRRTTP ----N- FHLPA SSMSVFDI CS | 405 |
| SEQ_ID_NO_227 | FTQMASLFVE QGDVMN--NK ----G- FHFPA ASMSLFDVLS | 396 |
| SEQ_ID_NO_229 | FTQMASLFVV QGATMD-- ----S- FSI PA ASMSLFDI LT | 388 |
| SEQ_ID_NO_230 | FTQMASLFVV QGAAMRRTTP ----L G- FSI PA SSMSTFDI LS | 415 |
| SEQ_ID_NO_231 | FTQMASLFVV QGAAMK--TN ----I K-D- FRI PA SSMSTFDI LS | 389 |

Figure 6L

| SEQ ID | | | | | |
|---|---|---|---|---|---|
| SEQ_ID_NO_209 | VAFFI FAYRR | FLDPLFARLN | KTERNKGLTE | LQRMGI GLVI | 429 |
| SEQ_ID_NO_211 | VAAFI FIYRR | VLDPLVARIR | KE--DPKGLTE | LQRMGI GLVI | 442 |
| SEQ_ID_NO_212 | VAAFI FIYRR | VLDPLVARLK | GT--KARGLTE | LQRMGI GLII | 427 |
| SEQ_ID_NO_213 | VVSFI FIYRR | LLDPLVARFT | KF--KSKGITE | LQRMGI GLVL | 424 |
| SEQ_ID_NO_214 | VLAFI AIYRR | VLVPVMSRLS | G---NPQGLTE | LQRMGI GLVI | 429 |
| SEQ_ID_NO_216 | VLAFI AIYRR | VLVPVMARLS | G---NPQGLTE | LQRMGVGLVI | 429 |
| SEQ_ID_NO_218 | VI AWWPVYDR | LLVPAVRSVT | G---RPRGFTQ | LQRMGI GLVV | 419 |
| SEQ_ID_NO_219 | VI YCVVI YDR | FLVPVVRKRT | G---HVRGFTQ | LQRMGI GLFI | 422 |
| SEQ_ID_NO_220 | VMWPVYDR | VI VPI VSKYT | K---RERGFTE | LQRMGI GLFI | 446 |
| SEQ_ID_NO_221 | VI VWWPMYDR | LLVPLARKFT | G---KERGFSE | LQRMGI GLFL | 436 |
| SEQ_ID_NO_222 | VI VWWPVYDR | LLVPI ARRFT | G---JERGFSE | LQRMGI GLFI | 433 |
| SEQ_ID_NO_223 | VI FWPVYDR | FI VPI ARKFT | G---KERGFSE | LQRMGI GLVV | 438 |
| SEQ_ID_NO_225 | VATTI FLYRR | AI CPFLARLT | G---RPAGPTE | LQRMGLGLVV | 443 |
| SEQ_ID_NO_227 | VLLCTGI YRQ | LLVPLAGRFS | G---NPRGLTE | LQRMGVGLI I | 434 |
| SEQ_ID_NO_229 | VLAFI AI YRR | VLVPVMARLS | G---NPQGLTE | LQRMGI GLVI | 426 |
| SEQ_ID_NO_230 | VI TTI FLYRR | AI CPLLARLT | G---RPTGPTE | LQRMGI GLVL | 453 |
| SEQ_ID_NO_231 | VAFFI FAYRR | FLDPLFARLN | KTEPNKGLTE | LQRMGI GLVI | 429 |

Figure 6M

| SEQ_ID_NO | Sequence | Pos |
|---|---|---|
| SEQ_ID_NO_209 | AI MAMI SAGI VEI HRL KNKE PE- SAT- S- --- -S- SSST | 461 |
| SEQ_ID_NO_211 | AI I AMVSAGI VELFRLKYAR KD- -CP- R- --- CE- SASS | 473 |
| SEQ_ID_NO_212 | AI I AMVAAGI VEWFRLKYAK KD- -CR- Q- --- CE- SESS | 458 |
| SEQ_ID_NO_213 | AI I AMVSAGL VEI FRLKYAL KEEKNCS- H- --- CE- GTSS | 458 |
| SEQ_ID_NO_214 | GMAAMVVAGV VEVERLKRVG A- --- --- --- PD- QPSS | 456 |
| SEQ_ID_NO_216 | GMAAMVVAGA VEVERLRRVA A- --- --- --- PD- QPSS | 456 |
| SEQ_ID_NO_218 | SMFAML AAGV LELVRLRTI A QR- GLY- G- --- EH- DVVP | 451 |
| SEQ_ID_NO_219 | SVLAMVVAAL VEI ERLKLAR RD- GVA- GN PQDEAL PVES | 459 |
| SEQ_ID_NO_220 | SI LAMVAAAL VEI RRLNI VK TY- DLVYD- --- KG- TPVP | 479 |
| SEQ_ID_NO_221 | SI LSMTAAAI VEI RRLQI AK SL- GLV- D- --- QN- VAVP | 468 |
| SEQ_ID_NO_222 | SML CMSAAAI VEI RRLQLAR DL- GLV- D- --- EA- VSVP | 465 |
| SEQ_ID_NO_223 | SVL CMSAAAI VEI KRLQLAK EL- DLV- D- --- KA- VPVP | 470 |
| SEQ_ID_NO_225 | GAL AMATAGT VEHFRKARAT A- --- --- --- -A- MSSD | 469 |
| SEQ_ID_NO_227 | GML AI L AAGA TEFERLKHI T P- --- --- --- GE- KASS | 461 |
| SEQ_ID_NO_229 | GMAAMVVAGV VEVERLKRVA A- --- --- --- PD- QPSS | 453 |
| SEQ_ID_NO_230 | GAMAMANAGT VEHFRKASAT T- --- --- --- -A- NGSE | 479 |
| SEQ_ID_NO_231 | AI TAMI SAGI VEI YRLKHKE T- --- --- --- AS- NSSS | 456 |

Figure 6N

| SEQ_ID | | | | | End |
|---|---|---|---|---|---|
| SEQ_ID_NO_209 | LSI FWQVPQY | MLI GASEVFM | YVGQLEFFNS | QAPTGLKSFA | 501 |
| SEQ_ID_NO_211 | LSI LWQI PQY | VLI GASEVFM | YVGQLEFFNG | QAPDGLKSFG | 513 |
| SEQ_ID_NO_212 | LSI FWQI PQY | VLI GASEVFM | YVGQLEFFND | QAPDGLKSFG | 498 |
| SEQ_ID_NO_213 | LSI FWQVPQY | VLI GASEVFM | YVGQLEFFNS | QAPDGLKSFG | 498 |
| SEQ_ID_NO_214 | LSVLWQVPQY | ALI GASEVFM | YVGQLEFFNG | QAPDGVKSFG | 496 |
| SEQ_ID_NO_216 | LSVLWQVPQY | ALI GASEVFM | YVGQLEFFNG | QAPDGVKSFG | 496 |
| SEQ_ID_NO_218 | _SI FWQVPQY | FII GAAEVFT | FVGQLEFFYD | QAPDAMRS[M]C | 491 |
| SEQ_ID_NO_219 | LTI F[V]QI PQY | FLI GAAEVFM | FVGQLEFFYD | QAPDAMRSL[M] | 499 |
| SEQ_ID_NO_220 | MSI FWQI PQY | FLVGASEVFT | FVGQLEFFYD | QSPDAMRSLC | 519 |
| SEQ_ID_NO_221 | MSI LWQI PQY | FLVGASEI FT | FI GQLEFFYD | QSPDAMRSLC | 508 |
| SEQ_ID_NO_222 | LSI FWQI PQY | FI LGAAEI FT | FI GQLEFFYD | QSPDAMRSLC | 505 |
| SEQ_ID_NO_223 | LTI F[L]QI PQY | FLLGAAEVFT | FVGQLEFFYD | QMPDAMRSLC | 510 |
| SEQ_ID_NO_225 | L[M][W]QVPQY | ALI GVSEVMM | YVGQLEFFNG | QMPDGLKSFG | 509 |
| SEQ_ID_NO_227 | LSI FWQI PQY | VLVGASEVFM | YVGQLEFFNG | QAPDGI KSFG | 501 |
| SEQ_ID_NO_229 | LSVLWQVPQY | ALI GASEVFM | YVGQLEFFNG | QAPDGVKSFG | 493 |
| SEQ_ID_NO_230 | LHI LWQVPQY | ALI GVSEVMM | YVGQLEFFNG | EMPDG[F]KSFG | 519 |
| SEQ_ID_NO_231 | LSI FWQVPQY | MMI GASEVFM | YVGQLEFFNS | QAPTGLKSFA | 496 |

Figure 60

| SEQ ID | Sequence | Length |
|---|---|---|
| SEQ_ID_NO_209 | SALCMASISL GNYVSSLLVS IVMKISTTD- DVHGWPENL | 540 |
| SEQ_ID_NO_211 | SALCMTSISL GNYVSSLLVT VVMKISTRD- EMPGWPGNL | 552 |
| SEQ_ID_NO_212 | SALCMTSISL GNYVSSLLVT IVMKFSTRD- QMPGWPSNL | 537 |
| SEQ_ID_NO_213 | SALCMTSISL GNYVSSLLVA IVMKISTRNE GMLGWPGNL | 538 |
| SEQ_ID_NO_214 | SALCMASISL GNYVSIMLVS VVTSLTAGD- RRPGWPGNL | 535 |
| SEQ_ID_NO_216 | SSLCMASISL GNYVSIMLVS VVTSLTAGE- RRPGWPGNL | 535 |
| SEQ_ID_NO_218 | SALSLTTVAL GNYLSTLLVT VVAKLTTRG- GKQGWPGNL | 530 |
| SEQ_ID_NO_219 | SALSLTTVAL GNYLSSVLVT VTEVTTKG- GKPGWPDNL | 538 |
| SEQ_ID_NO_220 | SALSLTTTAL GNYLSSLIVT IVMFATTKG- GNLGWPNNL | 558 |
| SEQ_ID_NO_221 | SALSLTTTAL GNYLSSFILT MVTTITTRG- GKPGWPDNL | 547 |
| SEQ_ID_NO_222 | SALSLTTSL GNYLSSFILT VVTSITTRG- GNPGWPDNL | 544 |
| SEQ_ID_NO_223 | SALCMMSMSL GNYFSDVIVS VVLYFTTRG- GRSGWPADL | 549 |
| SEQ_ID_NO_225 | SSLCMASISL GNYVSSLLVY AVTRLTTTR- ENPGWPNNL | 548 |
| SEQ_ID_NO_227 | SALCMASISL GNYVSIMLVS MVMGITARG- KRPGWPGNL | 540 |
| SEQ_ID_NO_229 | SALCMMSMSL GNYFSDIIVS VVTSLTAGE- GRPGWPADL | 532 |
| SEQ_ID_NO_230 | SALCMASISL GNYVSSLLVS AVTKATAVD- DLPGWPGNL | 558 |
| SEQ_ID_NO_231 | SALCMASISL GNYVSSLLVS IVMKISTRD- | 535 |

Figure 6P

| SEQ_ID_NO | | | | | |
|---|---|---|---|---|---|
| SEQ_ID_NO_209 | NKGHLERFYF | LAGLTAADF | VVYLICAKWY | K-YIKSEASF | 579 |
| SEQ_ID_NO_211 | NKGHLDRFFF | LLAVLTADL | VLYIICARWY | K-YIKFERQQ | 591 |
| SEQ_ID_NO_212 | NKGHLDRFYF | LLAALTMADF | GVYIICAKWY | K-SIKLEGKY | 576 |
| SEQ_ID_NO_213 | NMGHLDRFYF | LLAALTAADL | LVYIAMARWY | K-YVKFHGNN | 577 |
| SEQ_ID_NO_214 | NSGHLDRFYF | LLAALSLVDL | AVYVACAVWY | K-GIKLDSNE | 574 |
| SEQ_ID_NO_216 | NSGHLDRFYF | LLAALSLVDL | AVYVACATWY | K-GIKLDGGG | 574 |
| SEQ_ID_NO_218 | NVGHLDYFFW | LLAALSLLNF | AVYLLIASWY | T-YKKTAG-  | 567 |
| SEQ_ID_NO_219 | NRGHLDYFFW | MLAILSI-LNI | IFYLVIAKFY | T-YKRVHNAA | 577 |
| SEQ_ID_NO_220 | NEGHLDYFFW | VLASLSVLNL | LVYVSCAHRY | K-YKKA···· | 593 |
| SEQ_ID_NO_221 | NEGHLDYFFW | LLAGLSFLNL | VIYVFCAAARY | K-CKKA···· | 582 |
| SEQ_ID_NO_222 | NGGHLDYFFW | LLAALSFFNL | VIYVFLCQMY | K-SKKA···· | 579 |
| SEQ_ID_NO_223 | NKGHLDYFS- | GLAGLSFLNM | FLYIVAAKRY | G-SGKVDGRS | 583 |
| SEQ_ID_NO_225 | NEGHLDKFYF | LLAVLAVADF | AVYLVCASRY | K-SINLGDGD | 587 |
| SEQ_ID_NO_227 | NVGHMDRFFF | LVAVLTALDF | VLYLLCARWY | K-GIKLDGGD | 579 |
| SEQ_ID_NO_229 | NSGHLDRFYF | LLAALSLVDL | AVYVACAMWY | RKSCKVEGRS | 571 |
| SEQ_ID_NO_230 | NEGHLNKFYF | LLAILSVADF | AVYLVFAGRY | K-GIKLDGGD | 598 |
| SEQ_ID_NO_231 | NKGHLDRFYF | LLAALTAADF | VVYLVCAKWY | K-YIKSEASF | 574 |

Figure 7A

| SEQ_ID_NO_370 | MGSSGADTPS | KEQ------ | ---QPPATSGA | ALPPVYPDWS | 31 |
| SEQ_ID_NO_374 | MGSSGADTPS | KTTKASAPQ- | EQQPPATSGA | ATPAVYPDWS | 39 |
| SEQ_ID_NO_376 | MGSSGADАPT | KTSKASAPQ- | EQQPPASSST | ATPAVYPDWA | 39 |
| SEQ_ID_NO_377 | MGSSGADTPT | KE------- | -QQPPATSSA | ATPVYPDWT | 31 |
| SEQ_ID_NO_378 | MGSSEAETPA | KANKASAPQ- | EQQPPATSST | ATPTVYPDWT | 39 |
| SEQ_ID_NO_384 | MGSSDMDKTA | KEKESKTQPP | TTTQEQSSAT | TTGTVNPDWT | 40 |
| SEQ_ID_NO_385 | MGSSDMDKTG | KEKEAKTPSA | ASTQEQPSTA | GAATVNPDWS | 40 |
| SEQ_ID_NO_386 | MGSSEMDKTA | KEKESKTPP- | TTTQEQSSTT | SAGTVNPDWS | 39 |
| SEQ_ID_NO_391 | MGSSEMDKTT | KEKESKTPPP | PTSQEQSSTT | GTGTINPEWP | 40 |
| SEQ_ID_NO_392 | MGSSEMDKTP | KEKESKTPP- | PTSQEQSSTT | ATGTINPDWP | 39 |

| SEQ_ID_NO_370 | SFQAYPPIPP | HGFFPSPVAS | SPQGHPFMWG | AQAMIPPYGT | 71 |
| SEQ_ID_NO_374 | SFQAYPPIPP | HGFFPSPVAS | SPQGHPYMWG | AQPMIPPYGT | 79 |
| SEQ_ID_NO_376 | NFQGYPPIPP | HGFFPSPVAS | SPQGHPYMWG | AQPMIPPYGT | 79 |
| SEQ_ID_NO_377 | NFQGYPPIPP | HGFFPSPVVS | SPQGHPYMWG | AQPMMPPYGT | 79 |
| SEQ_ID_NO_378 | SFQGYPPIPP | HGFFPSPVVS | NPQGHPYMWG | AQPMMPPYGT | 71 |
| SEQ_ID_NO_384 | GFQAYSPIPP | HGFV----AS | SPQAHPYMWG | PQPMMPPYGT | 79 |
| SEQ_ID_NO_385 | GFQAYSPHPP | PGFL----AS | SPQAHPYMWG | VQPIMPPYGT | 76 |
| SEQ_ID_NO_386 | GFQAYSPIPP | HGFL----AS | SPQAHPYMWG | VQHIMPPYGT | 76 |
| SEQ_ID_NO_391 | GFQAYSPIPP | HGFL----AS | SPQAHPYMWG | VQHLMPPYGT | 75 |
| SEQ_ID_NO_392 | GFQAYSPIPP | HGFL----AS | SPQAHPYMWG | VQQFMPPYGT | 76 |
| | | | | VQQFMPPYGT | 75 |

| SEQ_ID_NO_370 | PPLPYV-MYP | PLGVYAHPSM | PPGAHPFTPY | AITSPNGNAD | 108 |
| SEQ_ID_NO_374 | PPPPYV-MYP | PLGVYAHPSM | PPGAHPFTPY | AITSPNGNAD | 117 |
| SEQ_ID_NO_376 | PPPPYV-MYP | PLGVYAHPSM | PPGAHPFTPY | AMASPNGNAD | 117 |
| SEQ_ID_NO_377 | PPL-YVLYP | PLGVYAHPSM | PPGAHPFAPY | AMASANGNAD | 108 |
| SEQ_ID_NO_378 | PPL-YVLYP | PGGIYAHPSM | PPGAHPFAPY | TMTSPNGNPD | 116 |
| SEQ_ID_NO_384 | PPHPYVAMYP | HSGIYAHPSI | RPGSYPFSPF | AMPSPNGIAE | 116 |
| SEQ_ID_NO_385 | PPHPYVAMYP | HLGVYAHPSI | PPGSYPFSPF | AMPSPNGIAE | 115 |
| SEQ_ID_NO_386 | PPHPYVAMYP | PGGLYAHPSI | PPGSYPFSPF | AMPSPNGIAE | 115 |
| SEQ_ID_NO_391 | PPHPYVAMYP | PGGIYAHPSM | PPGSYPFNPF | AMPSPNGIAE | 116 |
| SEQ_ID_NO_392 | PPHPYVAMYP | PGGIYAHPSM | PPGSYPFSPF | AMPSPNGIAE | 115 |

Figure 7B

| SEQ ID | | | | | | |
|---|---|---|---|---|---|---|
| SEQ_ID_NO_370 | ATGTTA---- | ------ | AAGNTDGKP | SEGKDKSPTK | RSKGSLGSLN | 143 |
| SEQ_ID_NO_374 | ATGTTA---- | ------ | AAGDTDGKP | SEGKDKSPTK | RSKGSLGSLN | 152 |
| SEQ_ID_NO_376 | PTGTTTTAAA | A----- | AAAGETDGKS | SEGKEKSPIK | RSKGSLGSLN | 157 |
| SEQ_ID_NO_377 | ATGTATAA-A | ------ | PSAGETDGKS | SEGKEKSPIK | SSKGSLGSLN | 147 |
| SEQ_ID_NO_378 | AAGTTLTA-- | ------ | TAGGETNGKS | SEGKEKLPIK | RSKGSLGSLN | 155 |
| SEQ_ID_NO_384 | ASGYTP---- | ------ | GNTEPDGKP | SDVKEKLPIK | RSKGSLGSLN | 151 |
| SEQ_ID_NO_385 | VSGNTP---- | ------ | GSMEAEGRP | SDAKEKLPIK | RSKGSLGSLN | 150 |
| SEQ_ID_NO_386 | TSGTTP---- | ------ | GSMEADGKS | SGKEKLPIK | RSKGSLGSLN | 150 |
| SEQ_ID_NO_391 | ASGNTP---- | ------ | GSMEADGKP | SEVKEKLPIK | RSKGSLGSLN | 151 |
| SEQ_ID_NO_392 | ASGNTP---- | ------ | GSMEADGKP | PEVKEKLPIK | RSKGSLGSLN | 150 |

| SEQ ID | | | | | | |
|---|---|---|---|---|---|---|
| SEQ_ID_NO_370 | MLTGKNPSEH | GKSSGASGNG | VTSQSGESGS | D--SSSEEGSE | | 181 |
| SEQ_ID_NO_374 | MLTGKNTGEH | GKTSGASANG | ATSQSGESGS | D--SSSEEGSE | | 190 |
| SEQ_ID_NO_376 | MITGKNSTEH | GKTSGASANG | AI SQSGESGS | E--SSSEEGSE | | 195 |
| SEQ_ID_NO_377 | MITGKNCVEH | GKTSGASANG | AITSQSGESGS | E--SSSEEGSE | | 185 |
| SEQ_ID_NO_378 | MITGKNCVEH | GKTSGASANG | AYSKSAESGS | E--SSSEEGSE | | 193 |
| SEQ_ID_NO_384 | MITGKN-NEL | GKTSGASANG | AYSKSAESGS | EL-GTSEEGSD | | 188 |
| SEQ_ID_NO_385 | MITGKN-NEH | GRTSGASANG | VYSKSGEESAS | EL-GTSEEGSD | | 187 |
| SEQ_ID_NO_386 | MLTGKN-NEL | GKTSANG | IHSKSGDSAS | E-GSSEEGSD | | 187 |
| SEQ_ID_NO_391 | MITGKN-NEH | GKTLRGTSANG | IHSKSGDSAS | EGEGTSEGSD | | 190 |
| SEQ_ID_NO_392 | MITGKN-NEH | GKTRGTSANG | IHSKSGDSAS | EGEGTSEGSD | | 189 |

| SEQ ID | | | | | | |
|---|---|---|---|---|---|---|
| SEQ_ID_NO_370 | GNSHNDSHHK | ESGGQEHDGDV | RSSRNGVSRL | QSE------ | | 214 |
| SEQ_ID_NO_374 | ENSHNDSHHK | ESGQEQDGDV | RSSQNGASRS | PSE------ | | 223 |
| SEQ_ID_NO_376 | ANSQNDSHHK | ESGQEQDGEV | RSSQNGVSRS | PSQ------ | | 228 |
| SEQ_ID_NO_377 | PNSQNDSHHK | ESGQEQDGEI | RSSQNGVSRS | PSQ------ | | 218 |
| SEQ_ID_NO_378 | ANSQNDSQHK | ESGQEQDGDV | RSSQNGVSPS | P-------- | | 226 |
| SEQ_ID_NO_384 | ANSQNDSQMK | SGGRQDS-E- | DASQNGGSAH | GLQNGGQ--A | | 224 |
| SEQ_ID_NO_385 | ADSQNDSQMK | SGGRQDSL-E | ETSQNGGSAH | AAQNGGQ-A | | 225 |
| SEQ_ID_NO_386 | ANSQSDSQLK | SGCRQDSLEA | ETSQNGSTCH | APQNGGPNTP | | 227 |
| SEQ_ID_NO_391 | ANSQNDSQLK | SGGRQDSFED | EPSQNGSSAY | TPQNGGLNDP | | 230 |
| SEQ_ID_NO_392 | ANSQNDSQMK | SGGRQDSFED | EPSQNGTSAY | TSQNGGISTP | | 229 |

| | | | | | |
|---|---|---|---|---|---|
|SEQ_ID_NO_370|SLRDEVNRIR|KEYEELLSRN|NSLKEKLEGK|QHKTDEA-GL|360|
|SEQ_ID_NO_374|SLRDEVNRIR|KEYEELLSKN|NSLKEKLEGK|QHKTDEA-GL|369|
|SEQ_ID_NO_376|SLRDEVNRIR|KEYDELLSKN|SSLKEKLEDK|QHKTDEA-GV|374|
|SEQ_ID_NO_377|TLRDEVNRVR|KEYDELISKN|NSLKDKLGDK|EHKTDDA-EL|364|
|SEQ_ID_NO_378|SLKDEVSRIR|KEYDELLSKN|SSLKDNVGDK|QHKTDEA-GL|372|
|SEQ_ID_NO_384|NLRSEVNRIK|SEYEQLLAEN|ASLKERLGEI|PGNDDL--RA|381|
|SEQ_ID_NO_385|NLRSEVNRIK|SEYEQLLSEN|ASLKERLGEV|HGQEDS--RA|383|
|SEQ_ID_NO_386|SLRAEVNRIK|SEYEQLLSEN|ASLKERLGEL|PGQDDHR-TG|386|
|SEQ_ID_NO_391|SLRSEVNRIR|SDYEQLLSEN|AALKERLGEL|PNDDHHHRS-|390|
|SEQ_ID_NO_392|SLRSEVSRIR|SDYEQLLSEN|TALKERLGEL|PA--------|375|

| | | | | | |
|---|---|---|---|---|---|
|SEQ_ID_NO_370|NNKLQHSADD|SQK-------|--KGN|----------|376|
|SEQ_ID_NO_374|NNKLQHSGDD|SQK-------|--KGN|----------|385|
|SEQ_ID_NO_376|DNKLQHSGDD|SQK-------|--KGN|----------|390|
|SEQ_ID_NO_377|DNKPQRSGDD|SQKK------|--ETN|----------|381|
|SEQ_ID_NO_378|DNKLQHSGDD|SQK-------|--DTN|----------|388|
|SEQ_ID_NO_384|SRNDQHLSND|TQKTEQT---|EIVQAGH|--------T-|405|
|SEQ_ID_NO_385|GRNDQHTSND|TQQTGQ----|EHGQGGH|----------|400|
|SEQ_ID_NO_386|GRNEQHSGND|TKQTGQTGQA|EAVQGGH|----------|413|
|SEQ_ID_NO_391|GRNDQHVGND|TQQSGQT---|EGVQGGH|----------|414|
|SEQ_ID_NO_392|--NDQHVGNE|AQQNGQT---|-------|----------|397|

US 10,480,000 B2

METHODS OF INCREASING CROP YIELD UNDER ABIOTIC STRESS

CROSS-REFERENCE TO RELATED APPLICATIONS

This application is a 371 National Stage application of International Application No. PCT/US2015/040614, filed Jul. 15, 2015, which claims the benefit of, and priority to, U.S. Provisional Patent Application Ser. No. 62/024,791, filed Jul. 15, 2014, the entire contents of which are hereby incorporated by reference.

STATEMENT AS TO FEDERALLY SPONSORED RESEARCH

This invention was made with government support under EDH-A-00-09-00009 awarded by the USAID. The government has certain rights in the invention.

TECHNICAL FIELD

This document relates to methods and materials involved in increasing yield in plants. For example, this document provides plants and materials and methods for making plants and plant products, where the plants have increased yield under abiotic stress conditions.

BACKGROUND

Environmental abiotic stresses diminish productivity of agricultural crops. Drought is a well-known example of an abiotic stress that periodically or chronically affects farming operations. Plants exposed to low water or drought conditions typically have low yields of plant material, seeds, fruit and other edible products. Some areas of the world consistently have low rainfall and limited irrigation opportunities, and therefore have problems growing sufficient food crops for their population.

Another type of abiotic stress relates to high salt levels in soil. If salt concentration exceeds a relatively low threshold, many plants suffer from stunted growth, necrosis, and even death, which results in reduced overall yields of plant material, seeds, fruit and other valuable products.

Yet another abiotic stress could be caused by lower than optimal soil fertilization. Nitrogen, as it could be supplied by nitrogen-containing fertilizers, is an essential, limiting nutrient required for plant growth. Fertilizer supplements are effective in increasing crop yields, yet their heavy use is detrimental to the environment, their application is costly, and their supply limited in some parts of the world. Thus, there is an ongoing need for methods and materials that allow increased harvest output for crops grown under various abiotic stress conditions.

SUMMARY

This document provides methods and materials related to plants having increased tolerance to abiotic stresses. For example, this document provides transgenic plants and plant cells having increased tolerance to drought, osmotic stress, and nitrogen deficiency, nucleic acids used to generate transgenic plants and plant cells having increased tolerance to such abiotic stresses, methods for making plants having increased tolerance to abiotic stresses, and methods for making plant cells that can be used to generate plants having increased tolerance to drought, osmotic stress, and nitrogen deficiency. Such plants and plant cells can be grown under such abiotic stress, with an increased yield.

In one aspect, this document features a method of increasing plant yield in a plant grown under drought stress, osmotic stress, or nitrogen deficiency. The method includes growing a plant comprising an exogenous nucleic acid under drought stress, osmotic stress, or nitrogen deficiency, the exogenous nucleic acid comprising a regulatory region operably linked to a nucleotide sequence encoding a polypeptide or a truncation of the polypeptide, wherein the HMM bit score of the amino acid sequence of the polypeptide is greater than about 65, the HMM based on the amino acid sequences depicted in any one of FIGS. 1-7, and wherein yield of the plant is increased as compared to the corresponding yield of a control plant that does not comprise said nucleic acid.

This document also features a method of increasing plant yield in a plant grown under drought stress, osmotic stress, or nitrogen deficiency. The method includes growing a plant comprising an exogenous nucleic acid under drought stress, osmotic stress, or nitrogen deficiency, the exogenous nucleic acid comprising a regulatory region operably linked to a nucleotide sequence encoding a polypeptide having at least 80% (e.g., at least 90%) sequence identity to an amino acid sequence set forth in SEQ ID NO: 2, 4, 6, 8, 9, 10, 11, 13, 15, 16, 17, 18, 20, 21, 22, 24, 25, 27, 29, 31, 33, 34, 35, 37, 39, 41, 42, 44, 46, 48, 49, 51, 52, 53, 54, 55, 56, 57, 58, 59, 61, 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, 109, 111, 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, 207, 209, 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, 335, 337, 338, 339, 340, 341, 342, 344, 345, 347, 348, 350, 352, 353, 354, 355, 356, 357, 358, 359, 360, 362, 364, 365, 366, 367, 368, 370, 372, 374, 375, 376, 377, 378, 379, 381, 382, 383, 384, 385, 386, 387, 388, 390, 391, 392, 394, 395, 396, 397, 399, 401, and 403, or a truncation of the polypeptide, and wherein yield of the plant is increased as compared to the corresponding yield of a control plant that does not comprise the nucleic acid.

In any of the methods, the method further can include harvesting biomass from said plant.

In another aspect, this document features a method of producing a plant with tolerance to drought stress, osmotic stress, or nitrogen deficiency. The method includes expressing in a plurality of plants an exogenous nucleic acid comprising a nucleotide sequence encoding a polypeptide or a truncation of the polypeptide, wherein the HMM bit score of the amino acid sequence of the polypeptide is greater than about 65, the HMM based on the amino acid sequences depicted in any one of FIGS. 1-7, and wherein yield of the plant is increased as compared to the corresponding yield of a control plant that does not comprise the nucleic acid, and selecting from the plurality a plant that has increased tolerance to drought stress, osmotic stress, or nitrogen deficiency.

This document also features a method of producing a plant with tolerance to drought stress, osmotic stress, or nitrogen deficiency. The method includes expressing in a plurality of plants an exogenous nucleic acid comprising a nucleotide sequence encoding a polypeptide or a truncation of the polypeptide, the exogenous nucleic acid comprising a regulatory region operably linked to a nucleotide sequence encoding a polypeptide having at least 80% (e.g., at least 90%) sequence identity to an amino acid sequence set forth in SEQ ID NO: 2, 4, 6, 8, 9, 10, 11, 13, 15, 16, 17, 18, 20, 21, 22, 24, 25, 27, 29, 31, 33, 34, 35, 37, 39, 41, 42, 44, 46, 48, 49, 51, 52, 53, 54, 55, 56, 57, 58, 59, 61, 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, 109, 111, 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, 207, 209, 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, 335, 337, 338, 339, 340, 341, 342, 344, 345, 347, 348, 350, 352, 353, 354, 355, 356, 357, 358, 359, 360, 362, 364, 365, 366, 367, 368, 370, 372, 374, 375, 376, 377, 378, 379, 381, 382, 383, 384, 385, 386, 387, 388, 390, 391, 392, 394, 395, 396, 397, 399, 401, and 403, or a truncation of said polypeptide, and wherein yield of the plant is increased as compared to the corresponding yield of a control plant that does not comprise the nucleic acid, and selecting from the plurality, a plant that has increased tolerance to drought stress, osmotic stress, or nitrogen deficiency.

In any of the methods, the plant can be grown under drought stress (e.g., pre-flowering or post-flowering drought stress).

In any of the methods, the plant can be grown under osmotic stress. For example, the osmotic stress can be selected from a soil electric conductivity between 4 and 5 dS/m, and a soil conductivity between 6 and 7 dS/m.

In any of the methods, the plant can be grown under nitrogen deficiency. The nitrogen deficiency can be selected from a 50 Kg per hectare nitrogen application, and a 75 Kg per hectare nitrogen application.

In any of the methods, the exogenous nucleic acid can have 80% or greater sequence identity to a nucleotide sequence selected from the group consisting of 1, 3, 5, 7, 12, 14, 19, 23, 26, 28, 30, 32, 36, 38, 40, 43, 45, 47, 50, 60, 62, 65, 67, 73, 78, 80, 83, 87, 90, 92, 94, 97, 101, 106, 110, 112, 114, 119, 121, 125, 127, 129, 132, 134, 136, 148, 150, 152, 161, 164, 166, 168, 170, 173, 175, 177, 180, 185, 188, 204, 208, 210, 215, 217, 224, 226, 228, 234, 241, 243, 245, 248, 252, 254, 256, 258, 260, 264, 268, 270, 272, 274, 277, 279, 281, 288, 290, 293, 295, 297, 303, 305, 307, 310, 313, 316, 318, 321, 325, 327, 329, 331, 336, 343, 346, 349, 351, 361, 363, 369, 371, 373, 380, 389, 393, 398, 400, and 402.

In any of the methods, the plant can be selected from the group consisting of *Panicum virgatum, Sorghum bicolor, Miscanthus giganteus, Saccharum* sp., *Populus balsamifera, Zea mays, Glycine max, Brassica napus, Triticum aestivum, Gossypium hirsutum, Oryza sativa, Helianthus annuus, Medicago sativa, Beta vulgaris*, or *Pennisetum glaucum*.

In any of the methods, the method can include growing the plant under osmotic stress, or nitrogen deficiency, wherein the HMM bit score of the amino acid sequence of the polypeptide is greater than about 65, the HMM based on the amino acid sequences depicted in FIG. 2 or 3.

In any of the methods, the method can include growing the plant under drought or nitrogen deficiency, wherein the HMM bit score of the amino acid sequence of the polypeptide is greater than about 65, the HMM based on the amino acid sequences depicted in FIG. 4.

This document also features a plant cell containing a modified endogenous nucleic acid. The nucleic acid comprising a nucleotide sequence encoding a polypeptide, wherein the HMM bit score of the amino acid sequence of the polypeptide is greater than about 65, the HMM based on the amino acid sequences depicted in one of FIGS. 1-7, and wherein a plant produced from the plant cell has a difference in tolerance to drought stress, osmotic stress, or nitrogen deficiency as compared to the corresponding composition of a control plant where said nucleic acid has not been modified. The plant can be selected from the group consisting of *Panicum virgatum, Sorghum bicolor, Miscanthus giganteus, Saccharum* sp., *Populus balsamifera, Zea mays, Glycine max, Brassica napus, Triticum aestivum, Gossypium hirsutum, Oryza sativa, Helianthus annuus, Medicago sativa, Beta vulgaris*, or *Pennisetum glaucum*.

The polypeptide can have 80 percent or greater sequence identity (e.g., 90 percent or greater or 95 percent or greater) to an amino acid sequence selected from the group consisting of SEQ ID NO:2, 4, 6, 8, 9, 10, 11, 13, 15, 16, 17, 18, 20, 21, 22, 24, 25, 27, 29, 31, 33, 34, 35, 37, 39, 41, 42, 44, 46, 48, 49, 51, 52, 53, 54, 55, 56, 57, 58, 59, 61, 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, 109, 111, 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, 207, 209, 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, 335, 337, 338, 339, 340, 341, 342, 344, 345, 347, 348, 350, 352, 353, 354, 355, 356, 357, 358, 359, 360, 362, 364, 365, 366, 367, 368, 370, 372, 374, 375, 376, 377, 378, 379, 381, 382, 383, 384, 385, 386, 387, 388, 390, 391, 392, 394, 395, 396, 397, 399, 401, and 403.

In another aspect, this document features a method of increasing plant yield in a plant grown under drought stress, osmotic stress, or nitrogen deficiency stress. The method includes growing a plant comprising a plant cell described herein under drought stress, osmotic stress, or nitrogen deficiency stress, and wherein yield of the plant is increased as compared to the corresponding yield of a control plant that does not comprise the modified endogenous nucleic acid.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims. The word "comprising" in the claims may be replaced by "consisting essentially of" or with "consisting of," according to standard practice in patent law.

REFERENCE TO AN ELECTRONIC SEQUENCE LISTING

The contents of the electronic sequence listing (CRES028US-revised ST25); Size: 1,592,333 bytes; and Date of Creation: Jun. 13, 2018) is herein incorporated by reference in its entirety.

DESCRIPTION OF DRAWINGS

FIGS. 1A-1D contain an alignment of the amino acid sequence of Clone 1805402 (SEQ ID NO: 2) with homologous and/or orthologous amino acid sequences. In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIGS. 2A-2F contain an alignment of the amino acid sequence of Annot 872104m (SEQ ID NO: 337) with homologous and/or orthologous amino acid sequences.

FIGS. 3A-3D contain an alignment of the amino acid sequence of Clone 26006 (SEQ ID NO: 61) with homologous and/or orthologous amino acid sequences.

FIGS. 4A-4E contain an alignment of the amino acid sequence of Clone 375578 (SEQ ID NO: 111) with homologous and/or orthologous amino acid sequences.

FIG. 5A-5E contain an alignment of the amino acid sequence of Clone 625057 (SEQ ID NO: 27) with homologous and/or orthologous amino acid sequences.

FIG. 6A-6Q contain an alignment of the amino acid sequence of Annot 878355 (SEQ ID NO: 209) with homologous and/or orthologous amino acid sequences.

FIG. 7A-7D contain an alignment of the amino acid sequence of Clone 258841 (SEQ ID NO: 370) with homologous and/or orthologous amino acid sequences.

DETAILED DESCRIPTION

Figure 6Q:
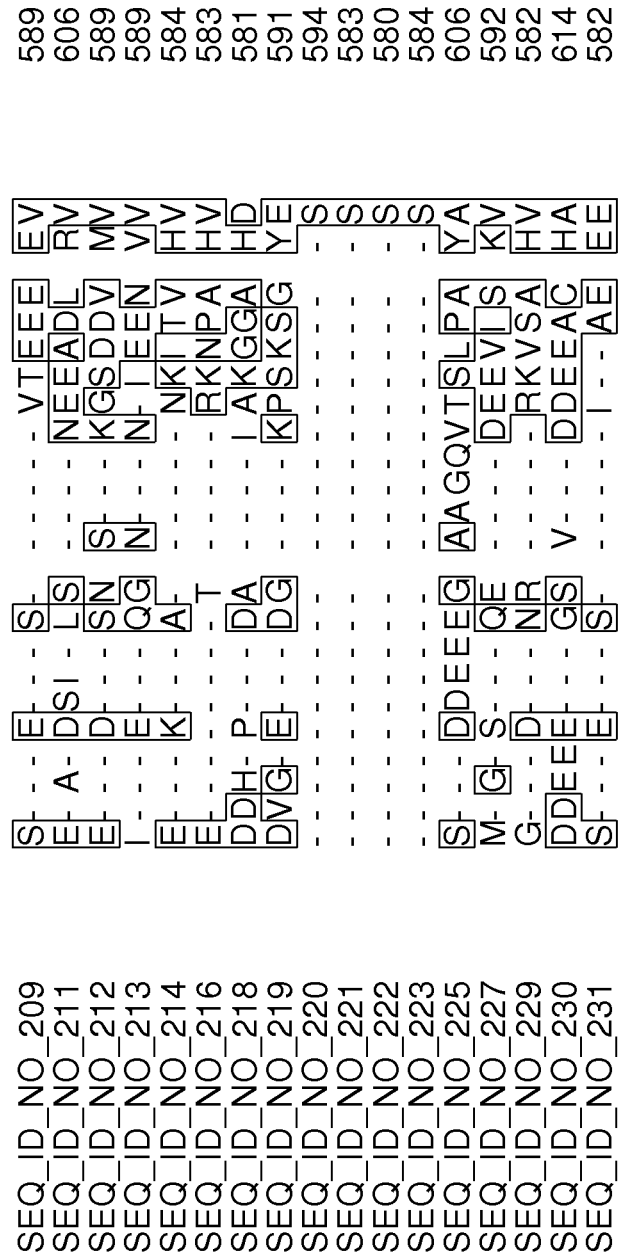

The invention features methods and materials related to increasing abiotic stress tolerance in plants. In some embodiments, the plants may have, for example, increased levels of drought tolerance, osmotic stress tolerance, or nitrogen deficiency tolerance. The methods described herein can include transforming a plant cell with a nucleic acid encoding an abiotic stress tolerance-increasing polypeptide, wherein expression of the polypeptide results in an increased level of abiotic stress tolerance. Plant cells produced using such methods can be grown to produce plants having an increased tolerance to drought, osmotic stress, and nitrogen deficiency. Such plants can have increased plant yield in under-irrigated fields or soil containing high salt or nitrogen deficiency.

I. Definitions

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic *Oryza sativa* plant transformed with and expressing the coding sequence for a nitrogen transporter polypeptide from a *Zea mays* plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Modulation" of the level of stress tolerance refers to the change in the level of the stress tolerance that is observed as a result of expression of, or transcription from, an exogenous or endogenous nucleic acid in a plant cell and/or plant. The change in level is measured relative to the corresponding level in control plants.

"Nucleic acid" and "polynucleotide" are used interchangeably herein, and refer to both RNA and DNA, including cDNA, genomic DNA, synthetic DNA, and DNA or RNA containing nucleic acid analogs. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell,* 1:977-984 (1989).

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

"Exemplified Polypeptides" refer to SEQ ID NOs: 2, 4, 6, 8, 9, 10, 11, 13, 15, 16, 17, 18, 20, 21, 22, 24, 25, 27, 29, 31, 33, 34, 35, 37, 39, 41, 42, 44, 46, 48, 49, 51, 52, 53, 54, 55, 56, 57, 58, 59, 61, 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, 109, 111, 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, 207, 209, 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, 335, 337, 338, 339, 340, 341, 342, 344, 345, 347, 348, 350, 352, 353, 354, 355, 356, 357, 358, 359, 360, 362, 364, 365, 366, 367, 368, 370, 372, 374, 375, 376, 377, 378, 379, 381, 382, 383, 384, 385, 386, 387, 388, 390, 391, 392, 394, 395, 396, 397, 399, 401, and 403.

II. Polypeptides

Polypeptides described herein include abiotic stress tolerance-increasing polypeptides. Abiotic stress tolerance-increasing polypeptides can be effective to modulate (e.g., increase) abiotic stress tolerance when expressed in a plant or plant cell. Such polypeptides typically contain at least one domain indicative of abiotic stress tolerance-increasing polypeptides, as described in more detail herein. Abiotic stress tolerance-increasing polypeptides typically have an HMM bit score that is greater than 65 as described in more detail herein. In some embodiments, abiotic stress tolerance-increasing polypeptides have greater than 80% identity to the Exemplified Polypeptides as described in more detail herein.

A. Domains Indicative of Abiotic Stress Tolerance-Increasing Polypeptides

An abiotic stress tolerance-increasing polypeptide can contain an AP2 domain and/or CMX-1 and CMX-2 motifs, which are predicted to be characteristic of an abiotic stress tolerance-increasing polypeptide. SEQ ID NO: 2 sets forth the amino acid sequence of a *Panicum virgatum* clone, identified herein as CeresClone: 1805402, that is predicted to encode a polypeptide containing an AP2 domain and CMX-1 and CMX-2 motifs. For example, an abiotic stress tolerance-increasing polypeptide can comprise an AP2 domain having 60 percent or greater (e.g., 65, 70, 75, 80, 85, 90, 95, 97, 98, 99, or 100 percent) sequence identity to residues 132 to 181 of SEQ ID NO: 2 and/or an CMX-1 motif and an CMX-2 motif having 60 percent or greater (e.g., 65, 70, 75, 80, 85, 90, 95, 97, 98, 99, or 100 percent) sequence identity to residues 56 to 78 and residues 88 to 99 of SEQ ID NO: 2, respectively. In some embodiments, an abiotic stress tolerance-increasing polypeptide can comprise an AP2 domain having 60 percent or greater (e.g., 65, 70, 75, 80, 85, 90, 95, 97, 98, 99, or 100 percent) sequence identity to the AP2 domain and/or an CMX-1 motif and an CMX-2 motif having 60 percent or greater (e.g., 65, 70, 75, 80, 85, 90, 95, 97, 98, 99, or 100 percent) sequence identity to the CMX-1 motif and CMX-2 motif of one or more of the polypeptides set forth in SEQ ID NOs: 4, 6, 8, 9, 10, 11, 13, 15, 16, 17, 18, 20, 21, 22, 24, or 25. The AP2, CMX-1, and CMX-2 domains of such sequences are set forth in the Sequence Listing. AP2 domain amino acid residues can bind to DNA and are typically found in transcription factor proteins. CMX-1 and CMX-2 motifs have been identified in the soybean and rice ERF transcription factors.

An abiotic stress tolerance-increasing polypeptide can contain a RPE65 domain, which is predicted to be characteristic of an abiotic stress tolerance-increasing polypeptide. SEQ ID NO: 337 sets forth the amino acid sequence of an *Arabidopsis thaliana* clone, identified herein as CeresAnnot: 872104m, that is predicted to encode a polypeptide containing a retinal pigment epithelial membrane protein (RPE65) domain. For example, an abiotic stress tolerance-increasing polypeptide can comprise a RPE65 domain having 60 percent or greater (e.g., 65, 70, 75, 80, 85, 90, 95, 97, 98, 99, or 100 percent) sequence identity to residues 124 to 589 of SEQ ID NO: 337. In some embodiments, an abiotic stress tolerance-increasing polypeptide can comprise a RPE65 domain having 60 percent or greater (e.g., 65, 70, 75, 80, 85, 90, 95, 97, 98, 99, or 100 percent) sequence identity to the RPE65 domain of one or more of the polypeptides set forth in SEQ ID NOs: 338, 339, 340, 341, 342, 344, 345, 347, 348, 350, 352, 353, 354, 355, 356, 357, 358, 359, 360, 362, 364, 365, 366, 367, or 368. The RPE65 domains of such sequences are set forth in the Sequence Listing. A polypeptide having a RPE65 domain can have 9-cis-epoxycarotenoid dioxygenase enzymatic activity, which is classified under EC 3.1.1.64.

An abiotic stress tolerance-increasing polypeptide can contain an alpha/beta hydrolase fold family domain, which is predicted to be characteristic of an abiotic stress tolerance-increasing polypeptide. SEQ ID NO: 61 sets forth the amino acid sequence of an *Arabidopsis thaliana* clone, identified herein as CeresClone:26006, that is predicted to encode a polypeptide containing an alpha/beta hydrolase fold family domain. For example, an abiotic stress tolerance-increasing polypeptide can comprise an alpha/beta hydrolase fold domain having 60 percent or greater (e.g., 65, 70, 75, 80, 85, 90, 95, 97, 98, 99, or 100 percent) sequence identity to residues 10 to 252 of SEQ ID NO: 61. In some embodiments, an abiotic stress tolerance-increasing polypeptide can comprise an alpha/beta hydrolase fold domain having 60 percent or greater (e.g., 65, 70, 75, 80, 85, 90, 95, 97, 98, 99, or 100 percent) sequence identity to the alpha/beta hydrolase fold domain of one or more of the polypeptides set forth in SEQ ID NOs: 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, or 109. The alpha/beta hydrolase fold domains of such sequences are set forth in the Sequence Listing. The alpha/beta hydrolase fold is common to a number of hydrolytic enzymes of widely differing phylogenetic origin and catalytic function. The core of each enzyme is an alpha/beta-sheet (rather than a barrel), containing 8 strands connected by helices. The enzymes are believed to have diverged from a common ancestor, preserving the arrangement of the catalytic residues. All have a catalytic triad, the elements of which are borne on loops, which are the best conserved structural features of the fold. A polypeptide having an alpha/beta hydrolase fold domain can have acetone-cyanohydrin lyase/methyl esterase (EC: 3.1.1.-) enzymatic activity.

An abiotic stress tolerance-increasing polypeptide can contain IQ calmodulin-binding motif domain and/or a DUF4005 domain, which are predicted to be characteristic of an abiotic stress tolerance-increasing polypeptide. SEQ ID NO: 111 sets forth the amino acid sequence of a *Zea mays* clone, identified herein as CeresClone:375578, that is predicted to encode a polypeptide containing an IQ calmodulin-binding motif domain and a DUF4005 domain. For example, an abiotic stress tolerance-increasing polypeptide can comprise an IQ calmodulin-binding motif domain having 60 percent or greater (e.g., 65, 70, 75, 80, 85, 90, 95, 97, 98, 99, or 100 percent) sequence identity to residues 139 to 157 of SEQ ID NO: 111 and/or a DUF4005 domain having 60 percent or greater (e.g., 65, 70, 75, 80, 85, 90, 95, 97, 98, 99, or 100 percent) sequence identity to residues 360 to 427 of SEQ ID NO: 111. In some embodiments, an abiotic stress tolerance-increasing polypeptide can comprise an IQ calmodulin binding motif and/or a DUF4005 domain having 60 percent or greater (e.g., 65, 70, 75, 80, 85, 90, 95, 97, 98, 99, or 100 percent) sequence identity to the IQ calmodulin binding motif and/or DUF4005 domain of one or more of the polypeptides set forth in SEQ ID NOs: 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, or 207. The IQ calmodulin binding motif and DUF4005 domains of such sequences are set forth in the Sequence Listing. The IQ calmodulin-binding motif domain is a consensus for calcium-independent binding of calmodulin, which is a calcium sensor and helps regulate events through its interaction with a diverse group of cellular proteins. See Rhoads and Friedberg, *FASEB J.*, 11(5):331-40 (1997). The DUF4005 domain is found in the C-terminal region of plant IQ-domain containing calmodulin-binding proteins.

An abiotic stress tolerance-increasing polypeptide can contain an aminotransferase class I and II domain and/or an allinase domain, which are predicted to be characteristic of an abiotic stress tolerance-increasing polypeptide. SEQ ID NO: 27 sets forth the amino acid sequence of a *Glycine max* clone, identified herein as CeresClone:625057, that is predicted to encode a polypeptide containing an aminotransferase class I and II domain and an allinase domain. For example, an abiotic stress tolerance-increasing polypeptide can comprise an aminotransferase class I and II domain having 60 percent or greater (e.g., 65, 70, 75, 80, 85, 90, 95, 97, 98, 99, or 100 percent) sequence identity to residues 89 to 453 of SEQ ID NO: 27 and/or an allinase domain having 60 percent or greater (e.g., 65, 70, 75, 80, 85, 90, 95, 97, 98, 99, or 100 percent) sequence identity to residues 230 to 318 of SEQ ID NO: 27. In some embodiments, an abiotic stress tolerance-increasing polypeptide can comprise an aminotransferase class I and II domain and/or allinase domain having 60 percent or greater (e.g., 65, 70, 75, 80, 85, 90, 95, 97, 98, 99, or 100 percent) sequence identity to the aminotransferase class I and II and allinase domains of one or more of the polypeptides set forth in SEQ ID NOs: 29, 31, 33, 34, 35, 37, 39, 41, 42, 44, 46, 48, 49, 51, 52, 53, 54, 55, 56, 57, 58, or 59. The aminotransferase class I and II and allinase domains of such sequences are set forth in the Sequence Listing. Aminotransferases share certain mechanistic features with other pyridoxal-phosphate dependent enzymes, such as the covalent binding of the pyridoxal-phosphate group to a lysine residue. On the basis of sequence similarity, these various enzymes can be grouped into class I and class II. Examples of polypeptides comprising aminotransferase class I and II domains include LL-DAP polypeptides (EC 2.6.1.83) (Watanabe et al., Mechanism of Substrate Recognition and PLP-induced Conformational Changes in LL-Diaminopimelate aminotransferase from *Arabidopsis thaliana. J. Mol. Biol.* 384, 1314-1329 (2008)). LL-DAP catalyzes the interconversion of LL-2,6-diaminoheptanedioate and 2-oxoglutarate to (S)-2,3,4,5-tetrahydropyridine-2,6-dicarboxylate, L-glutamate, and water. The allinase domain is an EFG like domain that is rich in disulfides that is found in allinase, a pyridoxal-5'-phosphate-dependent enzyme. See, e.g., Kuettner et al., *J. Biol. Chem.*, 277(48): 46402-46407 (2002).

An abiotic stress tolerance-increasing polypeptide can contain a PTR2 POT family domain, which is predicted to be characteristic of an abiotic stress tolerance-increasing polypeptide. SEQ ID NO: 209 sets forth the amino acid sequence of an *Arabidopsis thaliana* clone, identified herein as CeresAnnot:878355, that is predicted to encode a polypeptide containing a PTR2 POT family domain. For example, an abiotic stress tolerance-increasing polypeptide can comprise a PTR2 POT domain having 60 percent or greater (e.g., 65, 70, 75, 80, 85, 90, 95, 97, 98, 99, or 100 percent) sequence identity to residues 101 to 508 of SEQ ID NO: 209. In some embodiments, an abiotic stress tolerance-increasing polypeptide can comprise a PTR2 POT domain having 60 percent or greater (e.g., 65, 70, 75, 80, 85, 90, 95, 97, 98, 99, or 100 percent) sequence identity to the alpha/beta hydrolase fold domain of one or more of the polypeptides set forth in SEQ ID NOs: 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, or 335. The PTR2 POT domains of such sequences are set forth in the Sequence Listing. The transport of peptides into cells is a well-documented biological phenomenon which is accomplished by specific, energy-dependent transporters found in a number of organisms as diverse as bacteria and humans. The PTR family of proteins is distinct from the ABC-type peptide transporters and was uncovered by sequence analyses of a number of recently discovered peptide transport proteins. These proteins seem to be mainly involved in the intake of small peptides with the concomitant uptake of a proton.

An abiotic stress tolerance-increasing polypeptide can contain a G-box binding protein MFMR domain and/or a bZIP transcription factor domain, which are predicted to be characteristic of an abiotic stress tolerance-increasing polypeptide. SEQ ID NO: 370 sets forth the amino acid sequence of a *Zea mays* clone, identified herein as CeresClone: 258841, that is predicted to encode a polypeptide containing a MFMR domain and a bZIP domain. For example, an abiotic stress tolerance-increasing polypeptide can comprise a MFMR domain having 60 percent or greater (e.g., 65, 70, 75, 80, 85, 90, 95, 97, 98, 99, or 100 percent) sequence identity to residues 1 to 188 of SEQ ID NO: 370 and/or a bZIP domain having 60 percent or greater (e.g., 65, 70, 75, 80, 85, 90, 95, 97, 98, 99, or 100 percent) sequence identity to residues 279 to 341 of SEQ ID NO: 370. In some embodiments, an abiotic stress tolerance-increasing polypeptide can comprise a MFMR and/or a bZIPdomain having 60 percent or greater (e.g., 65, 70, 75, 80, 85, 90, 95, 97, 98, 99, or 100 percent) sequence identity to the MFMR and/or bZIP domains of one or more of the polypeptides set forth in SEQ ID NOs: 372, 374, 375, 376, 377, 378, 379, 381, 382, 383, 384, 385, 386, 387, 388, 390, 391, 392, 394, 395, 396, 397, 399, 401, and 403. The MFMR and bZIP domains of such sequences are set forth in the Sequence Listing. The MFMR region is typically found to the N-terminus of the PF00170 transcription factor domain. It is typically between 150 and 200 amino acids in length. The N-terminal half is typically rather rich in proline residues and has been termed the PRD (proline rich domain) whereas the C-terminal half is typically more polar and has been called the MFMR (multifunctional mosaic region). This family may be composed of three sub-families called A, B and C classified according to motif composition. Some of these motifs may be involved in mediating protein-protein interactions. The MFMR region can contain a nuclear localisation signal in bZIP opaque and GBF-2. The MFMR also can contain a transregulatory activity in TAF-1. The MFMR in CPRF-2 can contain cytoplasmic retention signals. The basic-leucine zipper (bZIP) transcription factors of eukaryotic cells are proteins that contain a basic region mediating sequence-specific DNA-binding followed by a leucine zipper region required for dimerization.

In some embodiments, an abiotic stress tolerance-increasing polypeptide is truncated at the amino- or carboxy-terminal end of a naturally occurring polypeptide. A truncated polypeptide may retain certain domains of the naturally occurring polypeptide while lacking others. Thus, length variants that are up to 5 amino acids shorter or longer typically exhibit the abiotic stress tolerance-increasing activity of a truncated polypeptide. In some embodiments, a truncated polypeptide is a dominant negative polypeptide. Expression in a plant of such a truncated polypeptide confers a difference in the level of abiotic stress tolerance of a plant as compared to the corresponding level of a control plant that does not comprise the truncation. The phenotype is cause by a truncation.

B. Functional Homologs Identified by Reciprocal BLAST

In some embodiments, one or more functional homologs of a reference abiotic stress tolerance-increasing polypeptide defined by one or more of the Pfam descriptions indicated above are suitable for use as abiotic stress tolerance-increasing polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for an abiotic stress tolerance-increasing polypeptide, or by combining domains from the coding sequences for different naturally-occurring abiotic stress tolerance-increasing polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of abiotic stress tolerance-increasing polypeptides. Sequence analysis can involve BLAST, Reciprocal BLAST, or PSI-BLAST analysis of nonredundant databases using an abiotic stress tolerance-increasing polypeptide amino acid sequence as the reference sequence Amino acid sequence is, in some instances, deduced from the nucleotide sequence. Those polypeptides in the database that have greater than 40% sequence identity are candidates for further evaluation for suitability as an abiotic stress tolerance-increasing polypeptide Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in abiotic stress tolerance-increasing polypeptides, e.g., conserved functional domains.

Conserved regions can be identified by locating a region within the primary amino acid sequence of an abiotic stress tolerance-increasing polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Figure 1B:
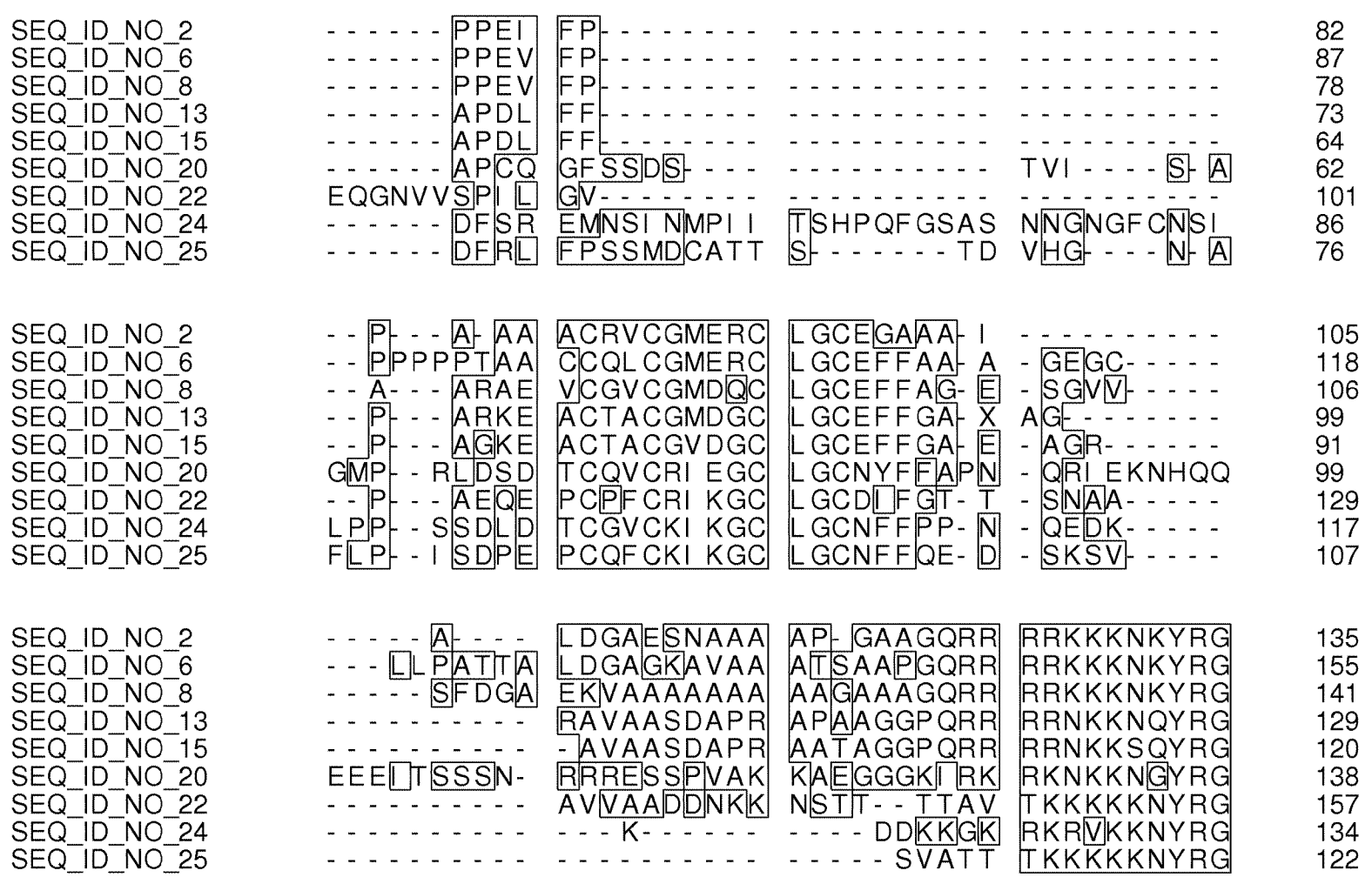

Examples of amino acid sequences of functional homologs of the polypeptide set forth in SEQ ID NO: 2 are provided in FIG. 1 and in the Sequence Listing. Such functional homologs include, for example, CeresClone: 278992 (SEQ ID NO: 4), CeresAnnot:6014857 (SEQ ID NO: 6), CeresAnnot:6318302 (SEQ ID NO: 8), GI:125603736 (SEQ ID NO: 9), GI:357148089 (SEQ ID NO: 10), GI:326518784 (SEQ ID NO: 11), CeresClone: 634402 (SEQ ID NO: 13), CeresClone:1494990 (SEQ ID NO: 15), GI:115479555 (SEQ ID NO: 16), GI:297802528 (SEQ ID NO: 17), GI:224123482 (SEQ ID NO: 18), CeresClone:123905 (SEQ ID NO: 20), GI:255555461 (SEQ ID NO: 21), GI:129560505 (SEQ ID NO: 22), CeresAnnot: 1460991 (SEQ ID NO: 24), or GI:225428806 (SEQ ID NO: 25). In some cases, a functional homolog of SEQ ID NO: 2 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2. In some cases, a functional homolog of SEQ ID NO: 2 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2 described above or set forth in the Sequence Listing.

Figure 2A:
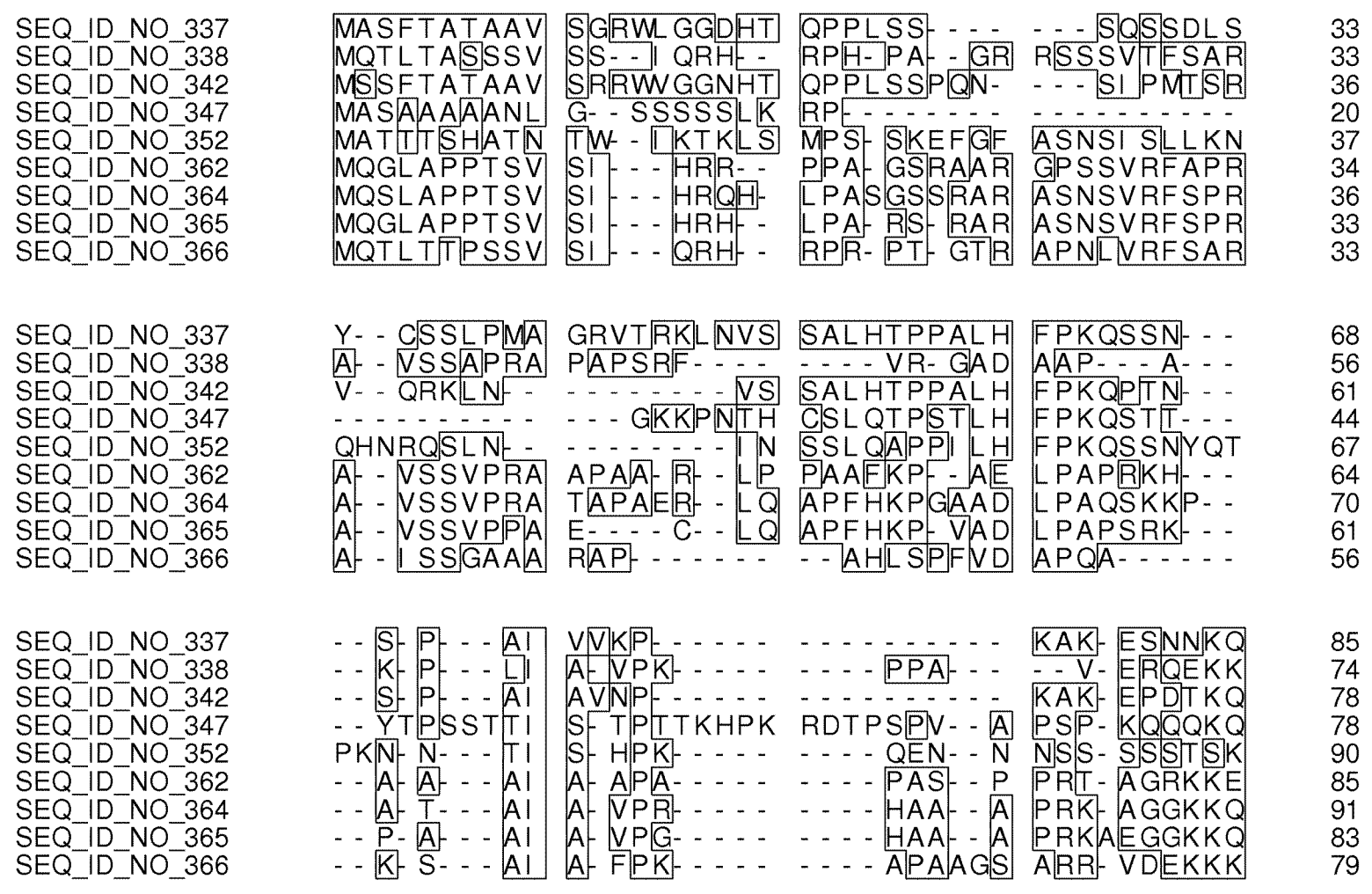

Examples of amino acid sequences of functional homologs of the polypeptide set forth in SEQ ID NO: 337 are provided in FIG. 2 and in the Sequence Listing. Such functional homologs include, for example, GI:112181147 (SEQ ID NO:338), GI:15810433 (SEQ ID NO:339), GI:297834326 (SEQ ID NO:340), GI:336420053 (SEQ ID NO:341), GI:345451248 (SEQ ID NO:342), CeresAnnot: 1480808 (SEQ ID NO:344), GI:355398706 (SEQ ID NO:345), CeresAnnot:1519993 (SEQ ID NO:347), GI:7209269 (SEQ ID NO:348), CeresClone:1943815 (SEQ ID NO:350), CeresAnnot:1138943 (SEQ ID NO:352), GI:38112198 (SEQ ID NO:353), GI:79155296 (SEQ ID NO:354), GI:317016344 (SEQ ID NO:355), GI:75185609 (SEQ ID NO:356), GI:22335699 (SEQ ID NO:357), GI:359806478 (SEQ ID NO:358), GI:112181145 (SEQ ID NO:359), GI:115454329 (SEQ ID NO:360), CeresClone: 1806409 (SEQ ID NO:362), CeresAnnot:8633702 (SEQ ID NO:364), GI:226529341 (SEQ ID NO:365), GI:357120366 (SEQ ID NO:366), GI:356577857 (SEQ ID NO:367), or GI:168065310 (SEQ ID NO:368). In some cases, a functional homolog of SEQ ID NO: 337 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 337. In some cases, a functional homolog of SEQ ID NO: 337 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 337 described above or set forth in the Sequence Listing.

Examples of amino acid sequences of functional homologs of the polypeptide set forth in SEQ ID NO: 61 are provided in FIG. 3 and in the Sequence Listing. Such functional homologs include, for example, CeresClone: 644331 (SEQ ID NO: 63), GI:15227859 (SEQ ID NO: 64), CeresAnnot:1504349 (SEQ ID NO: 66), CeresAnnot: 1265088 (SEQ ID NO: 68), US20070214517-97126 (SEQ ID NO: 69), GI:125527987 (SEQ ID NO: 70), GI:14279437 (SEQ ID NO: 71), ES902065 (SEQ ID NO: 72), CeresClone:1065042 (SEQ ID NO: 74), GI:157329790 (SEQ ID NO: 75), GI:15227861 (SEQ ID NO: 76), GI:146272407 (SEQ ID NO: 77), CeresClone:95094 (SEQ ID NO: 79), CeresClone:1714893 (SEQ ID NO: 81), GI:157329890 (SEQ ID NO: 82), CeresAnnot:859635 (SEQ ID NO: 84), GI:115440397 (SEQ ID NO: 85), GI:40549303 (SEQ ID NO: 86), CeresAnnot:1457048 (SEQ ID NO: 88), GI:50401192 (SEQ ID NO: 89), CeresAnnot:1451281 (SEQ ID NO: 91), CeresAnnot:1510252 (SEQ ID NO: 93), CeresClone:1822691 (SEQ ID NO: 95), GI:197312921 (SEQ ID NO: 96), CeresAnnot:8456439 (SEQ ID NO: 98), SEQ ID NO: 99, GI:15028131 (SEQ ID NO: 100), CeresClone: 270875 (SEQ ID NO: 102), GI:27754457 (SEQ ID NO: 103), GI:16648679 (SEQ ID NO: 104), GI:15227863 (SEQ ID NO: 105), CeresAnnot:1451282 (SEQ ID NO: 107), GI:53830670 (SEQ ID NO: 108), or GI:146272405 (SEQ ID NO: 109). In some cases, a functional homolog of SEQ ID NO: 61 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 61. In some cases, a functional homolog of SEQ ID NO: 61 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 61 described above or set forth in the Sequence Listing.

Examples of amino acid sequences of functional homologs of the polypeptide set forth in SEQ ID NO: 111 are provided in FIG. 4 and in the Sequence Listing. Such functional homologs include, for example, CeresAnnot: 8669409 (SEQ ID NO: 113), CeresClone:2034697 (SEQ ID NO: 115), GI:115440873 (SEQ ID NO: 116), GI:357125736 (SEQ ID NO: 117), GI:225449126 (SEQ ID NO: 118), CeresAnnot:1465047 (SEQ ID NO: 120), CeresClone: 1919901 (SEQ ID NO: 122), GI:356565733 (SEQ ID NO: 123), GI:15231175 (SEQ ID NO: 124), CeresClone:106263 (SEQ ID NO: 126), CeresAnnot:247223212 (SEQ ID NO: 128), CeresAnnot:200200100 (SEQ ID NO: 130), GI:7413581 (SEQ ID NO: 131), CeresClone:228069 (SEQ ID NO: 133), CeresClone:467508 (SEQ ID NO: 135), CeresClone:1829581 (SEQ ID NO: 137), GI:357510601 (SEQ ID NO: 138), GI:357129039 (SEQ ID NO: 139), GI:326525172 (SEQ ID NO: 140), GI:357443381 (SEQ ID NO: 141), GI:168063380 (SEQ ID NO: 142), GI:312282973 (SEQ ID NO: 143), GI:125550655 (SEQ ID NO: 144), GI:145357576 (SEQ ID NO: 145), GI:125528277 (SEQ ID NO: 146), GI:224032591 (SEQ ID NO: 147), CeresClone: 1747444 (SEQ ID NO: 149), CeresClone:1998974 (SEQ ID NO: 151), CeresClone:1883040 (SEQ ID NO: 153), GI:326520123 (SEQ ID NO: 154), GI:215701453 (SEQ ID NO: 155), GI:147809623 (SEQ ID NO: 156), GI:224109704 (SEQ ID NO: 157), GI:225439898 (SEQ ID NO: 158), GI:218196002 (SEQ ID NO: 159), GI:54306075 (SEQ ID NO: 160), CeresAnnot:1484880 (SEQ ID NO: 162), GI:224028605 (SEQ ID NO: 163), CeresAnnot:1528800 (SEQ ID NO: 165), CeresClone:1792902 (SEQ ID NO: 167), CeresClone:1806867 (SEQ ID NO: 169), CeresClone: 1727738 (SEQ ID NO: 171), GI:238007500 (SEQ ID NO: 172), CeresAnnot:8724651 (SEQ ID NO: 174), CeresClone: 1897134 (SEQ ID NO: 176), CeresClone:1859266 (SEQ ID NO: 178), GI:194696788 (SEQ ID NO: 179), CeresAnnot: 1475350 (SEQ ID NO: 181), GI:326490361 (SEQ ID NO: 182), GI:224140165 (SEQ ID NO: 183), GI:255577665 (SEQ ID NO: 184), CeresClone:1886384 (SEQ ID NO: 186), GI:255568402 (SEQ ID NO: 187), CeresClone: 1942871 (SEQ ID NO: 189), GI:326527367 (SEQ ID NO: 190), GI:297816500 (SEQ ID NO: 191), GI:297810377 (SEQ ID NO: 192), GI:302762472 (SEQ ID NO: 193), GI:302815615 (SEQ ID NO: 194), GI:116787496 (SEQ ID NO: 195), GI:224029961 (SEQ ID NO: 196), GI:15232741 (SEQ ID NO: 197), GI:302806862 (SEQ ID NO: 198), GI:302772817 (SEQ ID NO: 199), GI:240254538 (SEQ ID NO: 200), GI:297833734 (SEQ ID NO: 201), GI:2739366 (SEQ ID NO: 202), GI:297825811 (SEQ ID NO: 203), CeresClone:375578m1 (SEQ ID NO: 205), CeresClone: 375578m2 (SEQ ID NO: 206), or GI:307135879 (SEQ ID NO: 207). In some cases, a functional homolog of SEQ ID NO: 111 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 111. In some cases, a functional homolog of SEQ ID NO: 111 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 111 described above or set forth in the Sequence Listing.

The polypeptide set forth in SEQ ID NO: 111, or the functional homologs set forth above or in the Sequence Listing, can be truncated at the N- or C-terminus or both. In one embodiment, a functional homolog of SEQ ID NO:111 contains an C-terminal truncation. For example, a functional homolog of SEQ ID NO: 111 can include a sequence of amino acids with significant sequence identity to the region corresponding approximately to residues 1 to 135 of SEQ ID NO: 111, such as SEQ ID NO:205.

Examples of amino acid sequences of functional homologs of the polypeptide set forth in SEQ ID NO: 27 are provided in FIG. 5 and in the Sequence Listing. Such functional homologs include, for example, CeresClone: 1925947 (SEQ ID NO: 29), CeresAnnot:1514501 (SEQ ID NO: 31), CeresAnnot:849672 (SEQ ID NO: 33), GI:157355942 (SEQ ID NO: 34), GI:115452503 (SEQ ID NO: 35), CeresClone:1790933 (SEQ ID NO: 37), CeresAnnot:8641620 (SEQ ID NO: 39), CeresClone:281497 (SEQ ID NO: 41), GI:168013851 (SEQ ID NO: 42), CeresClone: 143214 (SEQ ID NO: 44), CeresClone:1781022 (SEQ ID NO: 46), CeresClone:618639 (SEQ ID NO: 48), GI:118483001 (SEQ ID NO: 49), CeresClone:38404 (SEQ ID NO: 51), GI:3549670 (SEQ ID NO: 52), GI:37703720 (SEQ ID NO: 53), GI:24414269 (SEQ ID NO: 54), GI:125603687 (SEQ ID NO: 55), GI:108707679 (SEQ ID NO: 56), GI:157352390 (SEQ ID NO: 57), GI:159469820 (SEQ ID NO: 58), or GI:145344081 (SEQ ID NO: 59). In some cases, a functional homolog of SEQ ID NO: 27 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 27. In some cases, a functional homolog of SEQ ID NO: 27 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 27 described above or set forth in the Sequence Listing.

Examples of amino acid sequences of functional homologs of the polypeptide set forth in SEQ ID NO: 209 are provided in FIG. 6 and in the Sequence Listing. Such functional homologs include, for example, CeresAnnot: 1472338_Pb (SEQ ID NO: 211), GI:157344683_Vv (SEQ ID NO: 212), GI:87240677_Mt (SEQ ID NO: 213), GI:115448297_Os (SEQ ID NO: 214), CeresClone:1844568 Pv (SEQ ID NO: 216), CeresClone:797829_Tm (SEQ ID NO: 218), GI:168033816_Pp (SEQ ID NO: 219), GI:116788004_Ps (SEQ ID NO: 220), GI:149900503_Ha (SEQ ID NO: 221), GI:4102839_Sl (SEQ ID NO: 222), GI:31088360_Vf (SEQ ID NO: 223), CeresAnnot:8681236 Sb (SEQ ID NO: 225), CeresAnnot:8519531_Gm (SEQ ID NO: 227), CeresAnnot:8631372_Zm (SEQ ID NO: 229), GI:151426449_Hv (SEQ ID NO: 230), GI:192757675_Br (SEQ ID NO: 231), GI:2655098 (SEQ ID NO: 232), GI:194690746 (SEQ ID NO: 233), CeresClone:752925 (SEQ ID NO: 235), GI:125540898 (SEQ ID NO: 236), GI:26451333 (SEQ ID NO: 237), GI:2160144 (SEQ ID NO: 238), GI:30696666 (SEQ ID NO: 239), GI:125556922 (SEQ ID NO: 240), CeresAnnot:1529287 (SEQ ID NO: 242), CeresClone:1806748 (SEQ ID NO: 244), CeresAnnot: 8755095 (SEQ ID NO: 246), GI:147827175 (SEQ ID NO: 247), CeresClone:1888865 (SEQ ID NO: 249), GI:157337163 (SEQ ID NO: 250), GI:115434472 (SEQ ID NO: 251), CeresAnnot:6252512 (SEQ ID NO: 253), CeresAnnot:1569074_Mt (SEQ ID NO: 255), CeresAnnot: 1475845 (SEQ ID NO: 257), CeresAnnot:1501483 (SEQ ID NO: 259), CeresAnnot:8755079 (SEQ ID NO: 261), GI:115470147 (SEQ ID NO: 262), GI:15240905 (SEQ ID NO: 263), CeresAnnot:8755085 (SEQ ID NO: 265), GI:147853446 (SEQ ID NO: 266), GI:157346087 (SEQ ID NO: 267), CeresAnnot:1538867 (SEQ ID NO: 269), CeresAnnot:8755091 (SEQ ID NO: 271), CeresAnnot:1492702 (SEQ ID NO: 273), CeresClone:325604 (SEQ ID NO: 275), GI:108707040 (SEQ ID NO: 276), CeresAnnot:1302517_At (SEQ ID NO: 278), CeresAnnot:1355964 (SEQ ID NO: 280), CeresAnnot:8755104 (SEQ ID NO: 282), GI:147802380 (SEQ ID NO: 283), GI:510238 (SEQ ID NO: 284), GI:157341962 (SEQ ID NO: 285), GI:6635838 (SEQ ID NO: 286), GI:4455276 (SEQ ID NO: 287), CeresAnnot: 8642246 (SEQ ID NO: 289), CeresAnnot:8633032 (SEQ ID NO: 291), GI:157337654 (SEQ ID NO: 292), CeresAnnot: 8642241 (SEQ ID NO: 294), CeresAnnot:1520085 (SEQ ID NO: 296), CeresAnnot:1514979 (SEQ ID NO: 298), GI:147858202 (SEQ ID NO: 299), GI:125545538 (SEQ ID NO: 300), GI:115451771 (SEQ ID NO: 301), GI:125587732 (SEQ ID NO: 302), CeresAnnot:1516968 (SEQ ID NO: 304), CeresClone:350844 (SEQ ID NO: 306), CeresAnnot: 8658700 (SEQ ID NO: 308), GI:157346088 (SEQ ID NO: 309), CeresClone:1926916 (SEQ ID NO: 311), GI:15226861 (SEQ ID NO: 312), CeresClone:816960 (SEQ ID NO: 314), GI:15232435 (SEQ ID NO: 315), CeresAnnot: 8643789 (SEQ ID NO: 317), CeresAnnot:8631367 (SEQ ID NO: 319), GI:157339093 (SEQ ID NO: 320), CeresAnnot: 8633031 (SEQ ID NO: 322), GI:125543029 (SEQ ID NO: 323), GI:115454995 (SEQ ID NO: 324), CeresAnnot: 8755090 (SEQ ID NO: 326), CeresAnnot:8755097 (SEQ ID NO: 328), CeresAnnot:8755098 (SEQ ID NO: 330), CeresAnnot:8755099 (SEQ ID NO: 332), WO2008034648-158133 (SEQ ID NO: 333), WO2008034648-158187 (SEQ ID NO: 334), or US7390893-0003 (SEQ ID NO: 335). In some cases, a functional homolog of SEQ ID NO: 209 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 209. In some cases, a functional homolog of SEQ ID NO: 209 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 209 described above or set forth in the Sequence Listing.

Examples of amino acid sequences of functional homologs of the polypeptide set forth in SEQ ID NO: 370 are provided in FIG. 7 and in the Sequence Listing. Such functional homologs include, for example, CeresClone: 645403 (SEQ ID NO: 372), CeresAnnot:8717693 (SEQ ID NO: 374), GI:212721672 (SEQ ID NO: 375), GI:115487934 (SEQ ID NO: 376), GI:357160384 (SEQ ID NO: 377), GI:208431904 (SEQ ID NO: 378), GI:326531522 (SEQ ID NO: 379), CeresClone:1910316 (SEQ ID NO: 381), GI:27469354 (SEQ ID NO: 382), GI:125536186 (SEQ ID NO: 383), GI:255555917 (SEQ ID NO: 384), GI:224074359 (SEQ ID NO: 385), GI:147845138 (SEQ ID NO: 386), GI:224139026 (SEQ ID NO: 387), GI:225427091 (SEQ ID NO: 388), CeresAnnot:1538994 (SEQ ID NO: 390), GI:356531457 (SEQ ID NO: 391), GI:13775109 (SEQ ID NO: 392), CeresAnnot:1447080 (SEQ ID NO: 394), GI:356496180 (SEQ ID NO: 395), GI:5381313 (SEQ ID NO: 396), GI:3336906 (SEQ ID NO: 397), CeresClone: 1611686 (SEQ ID NO: 399), CeresClone:1927515 (SEQ ID NO: 401), and CeresAnnot:834509 (SEQ ID NO: 403). In some cases, a functional homolog of SEQ ID NO: 370 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 370. In some cases, a functional homolog of SEQ ID NO: 370 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 370 described above or set forth in the Sequence Listing.

The identification of conserved regions in an abiotic stress tolerance-increasing polypeptide facilitates production of variants of abiotic stress tolerance-increasing polypeptides. Variants of abiotic stress tolerance-increasing polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIG. 1, FIG. 2, FIG. 3, or FIG. 4, FIG. 5, FIG. 6, or FIG. 7 and/or homologs identified in the Sequence Listing. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at a position marked by dashes, such a polypeptide has a length that is the sum of the amino acid residues in all conserved regions and all dashes.

C. Functional Homologs Identified by HMMER

In some embodiments, useful abiotic stress tolerance-increasing polypeptides include those that fit a Hidden Markov Model based on the polypeptides set forth in any one of FIGS. 1-7. A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMer 3.0 with default program parameters, using the sequences of the group of functional homologs as input. In some instances, the input files can be in FASTA format. HMMer is provided by the Howard Hughes Medical Institute (hmmer.janelia.org).

The multiple sequence alignment is generated by ProbCons (Do et al., *Genome Res.*, 15(2):330-40 (2005)) version 1.12 using default parameters: ProbCons is a public domain software program. ProbCons and HMMer can be found on the world wide web at fr.com/probcons/.

The HMM for a group of functional homologs can be used to determine the likelihood that a candidate abiotic stress tolerance-increasing polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMer hmmsearch program. The following parameter is used when running hmmsearch: the E-value cutoff for reporting is set to 1 ("–E 1"). A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The abiotic stress tolerance-increasing polypeptides discussed below fit the indicated HMM with an HMM bit score greater than to 65 (e.g., greater than 70, 80, 90, 100, 120, 140, 200, 300, 400, 500, 600, 700, 800, 900, 1000, 1500, or 2000). In some embodiments, the HMM bit score of an abiotic stress tolerance-increasing polypeptide discussed below is about 50%, 60%, 70%, 80%, 90%, or 95% of the HMM bit score of a functional homolog provided in the Sequence Listing of this application. In some embodiments, an abiotic stress tolerance-increasing polypeptide discussed below fits the indicated HMM with an HMM bit score greater than 210, and has a domain indicative of an abiotic stress tolerance-increasing polypeptide. In some embodiments, an abiotic stress tolerance-increasing polypeptide discussed below fits the indicated HMM with an HMM bit score greater than 210, and has 65% or greater sequence identity (e.g., 75%, 80%, 85%, 90%, 95%, or 100% sequence identity) to an amino acid sequence shown in any one of FIGS. 1-7.

Examples of polypeptides are shown in the sequence listing that have HMM bit scores greater than 260 (e.g., greater than 265, 270, 275, 280, 285, 290, 295, 300, 305, 310, 315, 320, 325, 330, 335, 340, or 342) when fitted to an HMM generated from the amino acid sequences set forth in FIG. 1 are identified in the Sequence Listing of this application. Such polypeptides include, for example, SEQ ID NOs: 2, 4, 6, 8, 9, 10, 11, 13, 15, 16, 17, 18, 20, 21, 22, 24, or 25.

Examples of polypeptides are shown in the sequence listing that have HMM bit scores greater than 730 (e.g., greater than 750, 775, 800, 825, 850, 875, 900, 925, 950, 975, 1000, 1025, 1050, 1075, 1100, 1125, 1150, 1175, 1200, 1210, or 1215) when fitted to an HMM generated from the amino acid sequences set forth in FIG. 2 are identified in the Sequence Listing of this application. Such polypeptides include, for example, SEQ ID NOs: 337, 338, 339, 340, 341, 342, 344, 345, 347, 348, 350, 352, 353, 354, 355, 356, 357, 358, 359, 360, 362, 364, 365, 366, 367, or 368.

Examples of polypeptides are shown in the sequence listing that have HMM bit scores greater than 350 (e.g., greater than 355, 360, 365, 370, 375, 380, 385, 390, 395, 400, 405, 410, 415, 420, 425, 430, 435, 440, 445, or 450) when fitted to an HMM generated from the amino acid sequences set forth in FIG. 3 are identified in the Sequence Listing of this application. Such polypeptides include, for example, SEQ ID NOs: 61, 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, or 109.

Examples of polypeptides are shown in the sequence listing that have HMM bit scores greater than 240 (e.g., greater than 250, 275, 300, 325, 350, 375, 400, 425, 450, 475, 500, 525, 550, 575, 600, 625, 650, 675, 700, 725, 750, 775, 800, 825, 840, or 850) when fitted to an HMM generated from the amino acid sequences set forth in FIG. 4 are identified in the Sequence Listing of this application. Such polypeptides include, for example, SEQ ID NOs: 111, 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, or 207.

Examples of polypeptides are shown in the sequence listing that have HMM bit scores greater than 610 (e.g., greater than 625, 650, 675, 700, 725, 750, 775, 800, 825, 850, 875, 900, 925, 950, 975, or 980) when fitted to an HMM generated from the amino acid sequences set forth in FIG. 5 are identified in the Sequence Listing of this application. Such polypeptides include, for example, SEQ ID NOs: 27, 29, 31, 33, 34, 35, 37, 39, 41, 42, 44, 46, 48, 49, 51, 52, 53, 54, 55, 56, 57, 58, or 59.

Examples of polypeptides are shown in the sequence listing that have HMM bit scores greater than 520 (e.g., greater than 550, 575, 600, 625, 650, 675, 700, 725, 750, 775, 800, 825, 850, 875, 900, 925, 950, 975, 1000, 1025, or 1040) when fitted to an HMM generated from the amino acid sequences set forth in FIG. 6 are identified in the Sequence Listing of this application. Such polypeptides include, for example, SEQ ID NOs: 209, 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, or 335.

Examples of polypeptides are shown in the sequence listing that have HMM bit scores greater than 525 (e.g., greater than 550, 575, 600, 625, 650, 675, 700, 725, or 750) when fitted to an HMM generated from the amino acid sequences set forth in FIG. 7 are identified in the Sequence Listing of this application. Such polypeptides include, for example, SEQ ID NOs: 370, 372, 374, 375, 376, 377, 378, 379, 381, 382, 383, 384, 385, 386, 387, 388, 390, 391, 392, 394, 395, 396, 397, 399, 401, and 403.

D. Percent Identity

In some embodiments, an abiotic stress tolerance-increasing polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NOs: 2, 4, 6, 8, 9, 10, 11, 13, 15, 16, 17, 18, 20, 21, 22, 24, 25, 27, 29, 31, 33, 34, 35, 37, 39, 41, 42, 44, 46, 48, 49, 51, 52, 53, 54, 55, 56, 57, 58, 59, 61, 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, 109, 111, 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, 207, 209, 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, 335, 337, 338, 339, 340, 341, 342, 344, 345, 347, 348, 350, 352, 353, 354, 355, 356, 357, 358, 359, 360, 362, 364, 365, 366, 367, 368, 370, 372, 374, 375, 376, 377, 378, 379, 381, 382, 383, 384, 385, 386, 387, 388, 390, 391, 392, 394, 395, 396, 397, 399, 401, or 403. Polypeptides having such a percent sequence identity often have a domain indicative of an abiotic stress tolerance-increasing polypeptide and/or have an HMM bit score that is greater than 65, as discussed above. Amino acid sequences of abiotic stress tolerance-increasing polypeptides having at least 80% sequence identity to one of the amino acid sequences set forth in SEQ ID NOs: 2, 4, 6, 8, 9, 10, 11, 13, 15, 16, 17, 18, 20, 21, 22, 24, 25, 27, 29, 31, 33, 34, 35, 37, 39, 41, 42, 44, 46, 48, 49, 51, 52, 53, 54, 55, 56, 57, 58, 59, 61, 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, 109, 111, 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, 207, 209, 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, 335, 337, 338, 339, 340, 341, 342, 344, 345, 347, 348, 350, 352, 353, 354, 355, 356, 357, 358, 359, 360, 362, 364, 365, 366, 367, 368, 370, 372, 374, 375, 376, 377, 378, 379, 381, 382, 383, 384, 385, 386, 387, 388, 390, 391, 392, 394, 395, 396, 397, 399, 401, and 403 are provided in FIGS. 1-7 and in the Sequence Listing.

"Percent sequence identity" refers to the degree of sequence identity between any given reference sequence, e.g., SEQ ID NO: 2, and a candidate abiotic stress tolerance-increasing sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al., *Nucleic Acids Res.*, 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, an abiotic stress tolerance-increasing polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2 Amino acid sequences of polypeptides having greater than 45% sequence identity to the polypeptide set forth in SEQ ID NO: 2 are provided in FIG. 1 and in the Sequence Listing.

In some cases, an abiotic stress tolerance-increasing polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 337 Amino acid sequences of polypeptides having greater than 45% sequence identity to the polypeptide set forth in SEQ ID NO: 337 are provided in FIG. 2 and in the Sequence Listing.

In some cases, an abiotic stress tolerance-increasing polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 61. Amino acid sequences of polypeptides having greater than 45% sequence identity to the polypeptide set forth in SEQ ID NO: 61 are provided in FIG. 3 and in the Sequence Listing.

In some cases, an abiotic stress tolerance-increasing polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:111. Amino acid sequences of polypeptides having greater than 45% sequence identity to the polypeptide set forth in SEQ ID NO: 111 are provided in FIG. 4 and in the Sequence Listing.

In some cases, an abiotic stress tolerance-increasing polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 27. Amino acid sequences of polypeptides having greater than 45% sequence identity to the polypeptide set forth in SEQ ID NO: 27 are provided in FIG. 5 and in the Sequence Listing.

In some cases, an abiotic stress tolerance-increasing polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 209 Amino acid sequences of polypeptides having greater than 45% sequence identity to the polypeptide set forth in SEQ ID NO: 209 are provided in FIG. 6 and in the Sequence Listing.

In some cases, an abiotic stress tolerance-increasing polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 370 Amino acid sequences of polypeptides having greater than 45% sequence identity to the polypeptide set forth in SEQ ID NO: 370 are provided in FIG. 7 and in the Sequence Listing.

E. Other Sequences

It should be appreciated that an abiotic stress tolerance-increasing polypeptide can include additional amino acids that are not involved in abiotic stress tolerance modulation, and thus such a polypeptide can be longer than would otherwise be the case. For example, an abiotic stress tolerance-increasing polypeptide can include a purification tag, a chloroplast transit peptide, a mitochondrial transit peptide, an amyloplast peptide, or a leader sequence added to the amino or carboxy terminus. In some embodiments, an abiotic stress tolerance-increasing polypeptide includes an amino acid sequence that functions as a reporter, e.g., a green fluorescent protein or yellow fluorescent protein.

III. Nucleic Acids

Nucleic acids described herein include nucleic acids that are effective to increase abiotic stress tolerance levels when transcribed in a plant or plant cell. Such nucleic acids include, without limitation, those that encode an abiotic stress tolerance-increasing polypeptide and those that can be used to inhibit expression of an abiotic stress tolerance-increasing polypeptide via a nucleic acid based method.

A. Nucleic Acids Encoding Abiotic Stress Tolerance-increasing Polypeptides

Nucleic acids encoding abiotic stress tolerance-increasing polypeptides are described herein. Examples of such nucleic acids include SEQ ID NOs: 1, 3, 5, 7, 12, 14, 19, 23, 26, 28, 30, 32, 36, 38, 40, 43, 45, 47, 50, 60, 62, 65, 67, 73, 78, 80, 83, 87, 90, 92, 94, 97, 101, 106, 110, 112, 114, 119, 121, 125, 127, 129, 132, 134, 136, 148, 150, 152, 161, 164, 166, 168, 170, 173, 175, 177, 180, 185, 188, 204, 208, 210, 215, 217, 224, 226, 228, 234, 241, 243, 245, 248, 252, 254, 256, 258, 260, 264, 268, 270, 272, 274, 277, 279, 281, 288, 290, 293, 295, 297, 303, 305, 307, 310, 313, 316, 318, 321, 325, 327, 329, 331, 336, 343, 346, 349, 351, 361, 363, 369, 371, 373, 380, 389, 393, 398, 400, and 402 as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs: 1, 3, 5, 7, 12, 14, 19, 23, 26, 28, 30, 32, 36, 38, 40, 43, 45, 47, 50, 60, 62, 65, 67, 73, 78, 80, 83, 87, 90, 92, 94, 97, 101, 106, 110, 112, 114, 119, 121, 125, 127, 129, 132, 134, 136, 148, 150, 152, 161, 164, 166, 168, 170, 173, 175, 177, 180, 185, 188, 204, 208, 210, 215, 217, 224, 226, 228, 234, 241, 243, 245, 248, 252, 254, 256, 258, 260, 264, 268, 270, 272, 274, 277, 279, 281, 288, 290, 293, 295, 297, 303, 305, 307, 310, 313, 316, 318, 321, 325, 327, 329, 331, 336, 343, 346, 349, 351, 361, 363, 369, 371, 373, 380, 389, 393, 398, 400, and 402.

An abiotic stress tolerance-increasing nucleic acid can comprise the nucleotide sequence set forth in SEQ ID NO:1. Alternatively, an abiotic stress tolerance-increasing nucleic acid can be a variant of the nucleic acid having the nucleotide sequence set forth in SEQ ID NO: 1. For example, an abiotic stress tolerance-increasing nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1.

An abiotic stress tolerance-increasing nucleic acid can comprise the nucleotide sequence set forth in SEQ ID NO:336. Alternatively, an abiotic stress tolerance-increasing nucleic acid can be a variant of the nucleic acid having the nucleotide sequence set forth in SEQ ID NO: 336. For example, an abiotic stress tolerance-increasing nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 336.

An abiotic stress tolerance-increasing nucleic acid can comprise the nucleotide sequence set forth in SEQ ID NO:60. Alternatively, an abiotic stress tolerance-increasing nucleic acid can be a variant of the nucleic acid having the nucleotide sequence set forth in SEQ ID NO: 60. For example, an abiotic stress tolerance-increasing nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 60.

An abiotic stress tolerance-increasing nucleic acid can comprise the nucleotide sequence set forth in SEQ ID NO:110. Alternatively, an abiotic stress tolerance-increasing nucleic acid can be a variant of the nucleic acid having the nucleotide sequence set forth in SEQ ID NO: 110. For example, an abiotic stress tolerance-increasing nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 110.

An abiotic stress tolerance-increasing nucleic acid can comprise the nucleotide sequence set forth in SEQ ID NO:26. Alternatively, an abiotic stress tolerance-increasing nucleic acid can be a variant of the nucleic acid having the nucleotide sequence set forth in SEQ ID NO: 26. For example, an abiotic stress tolerance-increasing nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 26.

An abiotic stress tolerance-increasing nucleic acid can comprise the nucleotide sequence set forth in SEQ ID NO:208. Alternatively, an abiotic stress tolerance-increasing nucleic acid can be a variant of the nucleic acid having the nucleotide sequence set forth in SEQ ID NO: 208. For example, an abiotic stress tolerance-increasing nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 208.

An abiotic stress tolerance-increasing nucleic acid can comprise the nucleotide sequence set forth in SEQ ID NO:369. Alternatively, an abiotic stress tolerance-increasing nucleic acid can be a variant of the nucleic acid having the nucleotide sequence set forth in SEQ ID NO: 369. For example, an abiotic stress tolerance-increasing nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 369.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from a DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of an Abiotic Stress Tolerance-Increasing Polypeptide A nucleic acid encoding one of the abiotic stress tolerance-increasing polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular abiotic stress tolerance-increasing polypeptide; i.e., for many amino acids, there is more than one nucleotide triplet that serves as the codon for the amino acid. Thus, codons in the coding sequence for a given abiotic stress tolerance-increasing polypeptide can be modified such that optimal expression in a particular plant species is obtained, using appropriate codon bias tables for that species.

In some cases, expression of an abiotic stress tolerance-increasing polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii. Inhibition of Expression of an Abiotic Stress Tolerance-Increasing Polypeptide Polynucleotides and recombinant constructs described herein can be used to inhibit expression of an abiotic stress tolerance-increasing polypeptide in a plant species of interest. See, e.g., Matzke and Birchler, *Nature Reviews Genetics* 6:24-35 (2005); Akashi et al., *Nature Reviews Mol. Cell Biology* 6:413-422 (2005); Mittal, *Nature Reviews Genetics* 5:355-365 (2004); and *Nature Reviews RNA interference collection*, Oct. 2005 on the World Wide Web at nature.com/reviews/focus/mai. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding abiotic stress tolerance-increasing polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid of a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad.*

*Sci. USA*, 92(13):6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of an abiotic stress tolerance-increasing polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the abiotic stress tolerance-increasing polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding an abiotic stress tolerance-increasing polypeptide, and the other strand of the stem portion of the double stranded RNA comprises a sequence that is similar or identical to the sequence that is complementary to the 3' or 5' untranslated region, respectively, or a fragment thereof, of the mRNA encoding the abiotic stress tolerance-increasing polypeptide. In other embodiments, one strand of the stem portion of a double stranded RNA comprises a sequence that is similar or identical to the sequence of an intron, or a fragment thereof, in the pre-mRNA encoding an abiotic stress tolerance-increasing polypeptide, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of an abiotic stress tolerance-increasing polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding an abiotic stress tolerance-increasing polypeptide, or a fragment of such sequences. In some embodiments, the sense or antisense sequence is identical or complementary to a sequence of the regulatory region that drives transcription of the gene encoding an abiotic stress tolerance-increasing polypeptide. In each case, the sense sequence is the sequence that is complementary to the antisense sequence.

The sense and antisense sequences can be a length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding an abiotic stress tolerance-increasing polypeptide described herein. The sense sequence complementary to the antisense sequence can be a sequence present within the mRNA of the abiotic stress tolerance-increasing polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have a suitable arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences or the left and right border-like sequences of the P-DNA flank, or are on either side of, the nucleic acid. See, U.S. Patent Publication No. 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, *Antisense Nucleic Acid Drug Dev.*, 7:187-195 (1997); Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

C. Constructs/Vectors

Recombinant constructs provided herein can be used to transform plants or plant cells in order to modulate abiotic stress tolerance levels. A recombinant nucleic acid construct can comprise a nucleic acid encoding an abiotic stress tolerance-increasing polypeptide as described herein, operably linked to a regulatory region suitable for expressing the abiotic stress tolerance-increasing polypeptide in the plant or cell. Thus, a nucleic acid can comprise a coding sequence that encodes an abiotic stress tolerance-increasing polypeptide as set forth in SEQ ID NOs: 2, 4, 6, 8, 9, 10, 11, 13, 15, 16, 17, 18, 20, 21, 22, 24, 25, 27, 29, 31, 33, 34, 35, 37, 39, 41, 42, 44, 46, 48, 49, 51, 52, 53, 54, 55, 56, 57, 58, 59, 61, 63, 64, 66, 68, 69, 70, 71, 72, 74, 75, 76, 77, 79, 81, 82, 84, 85, 86, 88, 89, 91, 93, 95, 96, 98, 99, 100, 102, 103, 104, 105, 107, 108, 109, 111, 113, 115, 116, 117, 118, 120, 122, 123, 124, 126, 128, 130, 131, 133, 135, 137, 138, 139, 140, 141, 142, 143, 144, 145, 146, 147, 149, 151, 153, 154, 155, 156, 157, 158, 159, 160, 162, 163, 165, 167, 169, 171, 172, 174, 176, 178, 179, 181, 182, 183, 184, 186, 187, 189, 190, 191, 192, 193, 194, 195, 196, 197, 198, 199, 200, 201, 202, 203, 205, 206, 207, 209, 211, 212, 213, 214, 216, 218, 219, 220, 221, 222, 223, 225, 227, 229, 230, 231, 232, 233, 235, 236, 237, 238, 239, 240, 242, 244, 246, 247, 249, 250, 251, 253, 255, 257, 259, 261, 262, 263, 265, 266, 267, 269, 271, 273, 275, 276, 278, 280, 282, 283, 284, 285, 286, 287, 289, 291, 292, 294, 296, 298, 299, 300, 301, 302, 304, 306, 308, 309, 311, 312, 314, 315, 317, 319, 320, 322, 323, 324, 326, 328, 330, 332, 333, 334, 335, 337, 338, 339, 340, 341, 342, 344, 345, 347, 348, 350, 352, 353, 354, 355, 356, 357, 358, 359, 360, 362, 364, 365, 366, 367, 368, 370, 372, 374, 375, 376, 377, 378, 379, 381, 382, 383, 384, 385, 386, 387, 388, 390, 391, 392, 394, 395, 396, 397, 399, 401, or 403. Examples of nucleic acids encoding abiotic stress tolerance-increasing polypeptides are set forth in SEQ ID NOs: 1, 3, 5, 7, 12, 14, 19, 23, 26, 28, 30, 32, 36, 38, 40, 43, 45, 47, 50, 60, 62, 65, 67, 73, 78, 80, 83, 87, 90, 92, 94, 97, 101, 106, 110, 112, 114, 119, 121, 125, 127, 129, 132, 134, 136, 148, 150, 152, 161, 164, 166, 168, 170, 173, 175, 177, 180, 185, 188, 204, 208, 210, 215, 217, 224, 226, 228, 234, 241, 243, 245, 248, 252, 254, 256, 258, 260, 264, 268, 270, 272, 274, 277, 279, 281, 288, 290, 293, 295, 297, 303, 305, 307, 310, 313, 316, 318, 321, 325, 327, 329, 331, 336, 343, 346, 349, 351, 361, 363, 369, 371, 373, 380, 389, 393, 398, 400, and 402, or in the Sequence Listing. The abiotic stress tolerance-increasing polypeptide encoded by a recombinant nucleic acid can be a native abiotic stress tolerance-increasing polypeptide, or can be heterologous to the cell. In some cases, the recombinant construct contains a nucleic acid that inhibits expression of an abiotic stress tolerance-increasing polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen® (Madison, Wis.), Clontech® (Palo Alto, Calif.), Stratagene® (La Jolla, Calif.), and Invitrogen/Life Technologies® (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; Ser. Nos. 10/957,569; 11/058,689; 11/172,703; 11/208,308; 11/274,890; 60/583,609; 60/612,891; Ser. Nos. 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; PCT/US07/62762; PCT/US2009/032485; and PCT/US2009/038792.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Another example of a broad promoter is the sequence of regulatory region PD3141 set forth in the sequence listing of PCT/US2009/032485. Therein, the expression pattern of the PD3141 regulatory region is described for TO rice plants overexpressing a construct comprising PD3141 driving expression of EGFP. In seedlings, expression was observed in: Tiller: not-specific; Main culm: not-specific; Root: not-specific; Leaf: not-specific; and Meristem: not-specific. In mature plants, expression was observed in: Main culm: bundle sheath, endodermis, epidermis, internode, ligule, node, pericycle, phloem, sclerenchyma layer, vasculature, xylem; Root: cortex, vascular; Panicle: flag leaf, ovary, peduncle, primary branch, rachilla, rachis, spiklet; Spiklet: flag leaf, floret(palea), lemma, ovule, pedicle, pollen, seed, stigma; Leaf: epidermis, leaf blade, leaf sheath, mesophyll; and Meristem: floral meristem, shoot apical meristem, vegetative meristem.

Another example of a broad promoter is the sequence of regulatory region p326 set forth in the sequence listing of U.S. application Ser. No. 10/981,334. Therein, the expression pattern of the p326 regulatory region is described for *Arabidopsis* plants. p326 expressed throughout most mature tissues screened. Expression was somewhat higher in epidermal, vascular and photosynthetic tissue of seedling. Lines characterized went through several generations.

Another example of a broad promoter is the sequence of regulatory region PD2995 (a 600 bp version of p326) set forth in the sequence listing of PCT/US2009/32485. In TO rice plants, PD2995 expresses very weakly throughout all tissues of the plant in both seedling and mature stages. Strongest expression detected in root tissue and embryo.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA,* 86:7890-7894 (1989)), root cell specific promoters reported by Conkling et al., *Plant Physiol.,* 93:1203-1211 (1990), and the tobacco RD2 promoter.

Another example of a root promoter is the sequence of regulatory region PD3561 set forth in the sequence listing of PCT/US2009/038792. Therein, the expression pattern of the PD3561 regulatory region is described for T0 rice plants overexpressing a construct comprising PD3561 driving expression of EGFP. Expression was observed in roots of seedlings in the cortex, epidermis, and vascular tissues. In mature plants, expression was observed strongly throughout the root with the exception of the root cap and in the cortex, epidermis, and vascular tissues.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell,* 1(9):839-853 (1989)), the soybean trypsin inhibitor promoter (Riggs et al., *Plant Cell,* 1(6):609-621 (1989)), the ACP promoter (Baerson et al., *Plant Mol. Biol.,* 22(2):255-267 (1993)), the stearoyl-ACP desaturase promoter (Slocombe et al., *Plant Physiol.,* 104(4):167-176 (1994)), the soybean α' subunit of β-conglycinin promoter (Chen et al., *Proc. Natl. Acad. Sci. USA,* 83:8560-8564 (1986)), the oleosin promoter (Hong et al., *Plant Mol. Biol.,* 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.,* 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao, *Plant Mol. Biol.,* 32:571-57 (1996); Conceicao, *Plant,* 5:493-505 (1994)); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan, *Genetics,* 142:1009-1020 (1996)); maize Cat3 (see, GenBank No. L05934; Abler, *Plant Mol. Biol.,* 22:10131-1038 (1993)). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* 20:647-654 (2001)), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.,* 35:773-778 (1994)), the Cab-1 promoter from wheat (Fejes et al., *Plant Mol. Biol.,* 15:921-932 (1990)), the CAB-1 promoter from spinach (Lubberstedt et al., *Plant Physiol.,* 104:997-1006 (1994)), the cab1R promoter from rice (Luan et al., *Plant Cell,* 4:971-981 (1992)), the pyruvate orthophosphate dikinase (PPDK) promoter from corn (Matsuoka et al., *Proc. Natl. Acad. Sci. USA,* 90:9586-9590 (1993)), the tobacco Lhcb1*2 promoter (Cerdan et al., *Plant Mol. Biol.,* 33:245-255 (1997)), the *Arabidopsis thaliana* SUC2 sucrose-H+symporter promoter (Truernit et al., *Planta,* 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell,* 3(10):1051-1061 (1991)), the Commelina yellow mottle virus (CoYMV) promoter (Medberry et al., *Plant Cell,* 4(2):185-192 (1992)), and the rice tungro baciliform virus (RTBV) promoter (Dai et al., *Proc. Natl. Acad. Sci. USA,* 101(2):687-692 (2004)).

ix. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) *Nature Biotech* 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Stem Promoters

A stem promoter may be specific to one or more stem tissues or specific to stem and other plant parts. Stem promoters may have high or preferential activity in, for example, epidermis and cortex, vascular cambium, procambium, or xylem. Examples of stem promoters include YP0018 which is disclosed in US20060015970 and CryIA (b) and CryIA(c) (Braga et al. 2003, *Journal of New Seeds* 5:209-221).

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding an abiotic stress tolerance-increasing polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. Transgenic Plants and Plant Cells

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous abiotic stress tolerance-increasing polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgenes. In some embodiments, a population of plants can be selected that has increased tolerance to drought or elevated saline levels, or increased nitrogen use efficiency. In some cases, selection and/or screening can be carried out over multiple transformation events. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in yield (e.g., grain, vegetative biomass, or stem sucrose yield) relative to a control plant that lacks the transgene. Selection and/or screening can be carried out to choose those transgenic plants having a statistically significant difference in an abiotic stress tolerance level relative to a control plant that lacks the transgene. Selected or screened transgenic plants have an altered phenotype as compared to a corresponding control plant, as described in the "Transgenic Plant Phenotypes" section herein.

A population of progeny of a single or distinct transformation event can be screened for those plants having a desired level of expression of an abiotic stress tolerance-increasing polypeptide or nucleic acid. Physical and biochemical methods can be used to identify expression levels. These include Southern analysis or PCR amplification for detection of a polynucleotide; Northern blots, 51 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis, and Zea.

Suitable species include Panicum spp., Sorghum spp., Miscanthus spp., Saccharum spp., Erianthus spp., Populus spp., Andropogon gerardii (big bluestem), Pennisetum purpureum (elephant grass), Phalaris arundinacea (reed canarygrass), Cynodon dactylon (bermudagrass), Festuca arundinacea (tall fescue), Spartina pectinata (prairie cordgrass), Medicago sativa (alfalfa), Arundo donax (giant reed), Secale cereale (rye), Salix spp. (willow), Eucalyptus spp. (eucalyptus), Triticosecale (triticum-wheat X rye) and bamboo.

Suitable species also include Helianthus annuus (sunflower), Carthamus tinctorius (safflower), Jatropha curcas (jatropha), Ricinus communis (castor), Elaeis guineensis (palm), Linum usitatissimum (flax), and Brassica juncea.

Suitable species also include Beta vulgaris (sugarbeet), and Manihot esculenta (cassava)

Suitable species also include Lycopersicon esculentum (tomato), Lactuca sativa (lettuce), Musa paradisiaca (banana), Solanum tuberosum (potato), Brassica oleracea (broccoli, cauliflower, Brussels sprouts), Camellia sinensis (tea), Fragaria ananassa (strawberry), Theobroma cacao (cocoa), Coffea arabica (coffee), Vitis vinifera (grape), Ananas comosus (pineapple), Capsicum annum (hot & sweet pepper), Allium cepa (onion), Cucumis melo (melon), Cucumis sativus (cucumber), Cucurbita maxima (squash), Cucurbita moschata (squash), Spinacea oleracea (spinach), Citrullus lanatus (watermelon), Abelmoschus esculentus (okra), and Solanum melongena (eggplant).

Suitable species also include Papaver somniferum (opium poppy), Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea spp., Andrographis paniculata, Atropa belladonna, Datura stomonium, Berberis spp., Cephalotaxus spp., Ephedra sinica, Ephedra spp., Erythroxylum coca, Galanthus wornorii, Scopolia spp., Lycopodium serratum (Huperzia serrata), Lycopodium spp., Rauwolfia serpentina, Rauwolfia spp., Sanguinaria canadensis, Hyoscyamus spp., Calendula officinalis, Chrysanthemum parthenium, Coleus forskohlii, and Tanacetum parthenium.

Suitable species also include Parthenium argentatum (guayule), Hevea spp. (rubber), Mentha spicata (mint), Mentha piperita (mint), Bixa orellana, and Alstroemeria spp.

Suitable species also include Rosa spp. (rose), Dianthus caryophyllus (carnation), Petunia spp. (petunia) and Poinsettia pulcherrima (poinsettia).

Suitable species also include Nicotiana tabacum (tobacco), Lupinus albus (lupin), Uniola paniculata (oats), bentgrass (Agrostis spp.), Populus tremuloides (aspen), Pinus spp. (pine), Abies spp. (fir), Acer spp. (maple), Hordeum vulgare (barley), Poa pratensis (bluegrass), Lolium spp. (ryegrass) and Phleum pratense (timothy).

In some embodiments, a suitable species can be a wild, weedy, or cultivated Pennisetum species such as, but not limited to, Pennisetum alopecuroides, Pennisetum arnhemicum, Pennisetum caffrum, Pennisetum clandestinum, Pennisetum divisum, Pennisetum glaucum, Pennisetum latifolium, Pennisetum macrostachyum, Pennisetum macrourum, Pennisetum orientale, Pennisetum pedicellatum, Pennisetum polystachion, Pennisetum polystachion ssp. Setosum, Pennisetum purpureum, Pennisetum setaceum, Pennisetum subangustum, Pennisetum typhoides, Pennisetum villosum, or hybrids thereof (e.g., Pennisetum purpureum x Pennisetum typhoidum).

In some embodiments, a suitable species can be a wild, weedy, or cultivated Miscanthus species and/or variety such as, but not limited to, Miscanthus x giganteus, Miscanthus sinensis, Miscanthus x ogiformis, Miscanthus floridulus, Miscanthus transmorrisonensis, Miscanthus oligostachyus, Miscanthus nepalensis, Miscanthus sacchariflorus, Miscanthus x giganteus 'Amuri', Miscanthus x giganteus 'Wagara', Miscanthus x giganteus 'Illinois', Miscanthus sinensis var. 'Goliath', Miscanthus sinensis var. 'Roland', Miscanthus sinensis var. 'Africa', Miscanthus sinensis var. 'Fern Osten', Miscanthus sinensis var. gracillimus, Miscanthus sinensis var. variegates, Miscanthus sinensis var. purpurascens, Miscanthus sinensis var. 'Malepartus', Miscanthus sacchariflorus var. 'Robusta', Miscanthus sinensis var. 'Silberfedher' (aka. Silver Feather), Miscanthus transmorrisonensis, Miscanthus condensatus, Miscanthus yakushimanum, Miscanthus var. 'Alexander', Miscanthus var. 'Adagio', Miscanthus var. 'Autumn Light', Miscanthus var. 'Cabaret', Miscanthus var. 'Condensatus', Miscanthus var. 'Cosmopolitan', Miscanthus var. 'Dixieland', Miscanthus var. 'Gilded Tower' (U.S. Pat. No. PP14,743), Miscanthus var. 'Gold Bar' (U.S. Pat. No. PP15,193), Miscanthus var. 'Gracillimus', Miscanthus var. 'Graziella', Miscanthus var. 'Grosse Fontaine', Miscanthus var. 'Hinjo aka Little Nicky'™, Miscanthus var. 'Juli', Miscanthus var. 'Kaskade', Miscanthus var. 'Kirk Alexander', Miscanthus var. 'Kleine Fontaine', Miscanthus var. 'Kleine Silberspinne' (aka. 'Little Silver Spider'), Miscanthus var. 'Little Kitten', Miscanthus var. 'Little Zebra' (U.S. Pat. No. PP13,008), Miscanthus var. 'Lottum', Miscanthus var. 'Malepartus', Miscanthus var. 'Morning Light', Miscanthus var. 'Mysterious Maiden' (U.S. Pat. No. PP16,176), Miscanthus var. 'Nippon', Miscanthus var. 'November Sunset', Miscanthus var. 'Parachute', Miscanthus var. 'Positano', Miscanthus var. 'Puenktchen'(aka 'Little Dot'), Miscanthus var. 'Rigoletto', Miscanthus var. 'Sarabande', Miscanthus var. 'Silberpfeil' (aka. Silver Arrow), Miscanthus var. 'Silverstripe', Miscanthus var. 'Super Stripe' (U.S. Pat. No. PP18,161), Miscanthus var. 'Strictus', or Miscanthus var. 'Zebrinus'.

In some embodiments, a suitable species can be a wild, weedy, or cultivated sorghum species and/or variety such as, but not limited to, Sorghum almum, Sorghum amplum, Sorghum angustum, Sorghum arundinaceum, Sorghum bicolor (such as bicolor, guinea, caudatum, kafir, and durra), Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum nigrum, Sorghum nitidum, Sorghum plumosum, Sorghum propinquum, Sorghum purpureosericeum, Sorghum stipoideum, Sorghum sudanensese, Sorghum timorense, Sorghum trichocladum, Sorghum versicolor, Sorghum virgatum, Sorghum vulgare, or hybrids such as Sorghum× almum, Sorghum x sudangrass or Sorghum x drummondii.

Thus, the methods and compositions can be used over a broad range of plant species, including species from the dicot genera Brassica, Carthamus, Glycine, Gossypium, Helianthus, Jatropha, Parthenium, Populus, and Ricinus; and the monocot genera Elaeis, Festuca, Hordeum, Lolium, Oryza, Panicum, Pennisetum, Phleum, Poa, Saccharum, Secale, Sorghum, Triticosecale, Triticum, and Zea. In some embodiments, a plant is a member of the species Panicum virgatum (switchgrass), Sorghum bicolor (sorghum, sudangrass), Miscanthus giganteus (miscanthus), Saccharum sp. (energycane), Populus balsamifera (poplar), Zea mays (corn), Glycine max (soybean), Brassica napus (canola), Triticum aestivum (wheat), Gossypium hirsutum (cotton), Oryza sativa (rice), Helianthus annuus (sunflower), Medicago sativa (alfalfa), Beta vulgaris (sugarbeet), or Pennisetum glaucum (pearl millet).

In certain embodiments, the polynucleotides and vectors described herein can be used to transform a number of monocotyledonous and dicotyledonous plants and plant cell systems, wherein such plants are hybrids of different species or varieties of a specific species (e.g., Saccharum sp. X Miscanthus sp., Sorghum sp. X Miscanthus sp., e.g., Panicum virgatum x Panicum amarum, Panicum virgatum x Panicum amarulum, and Pennisetum purpureum x Pennisetum typhoidum).

D. Transgenic Plant Phenotypes

Transgenic plants have increased tolerance to abiotic stress, such as increased tolerance to drought stress or improved water use efficiency, increased tolerance to osmotic stress or to elevated salinity levels, and/or increased tolerance to nitrogen deficiency stress or improved nitrogen use efficiency.

Plant species vary in their capacity to tolerate osmotic stress. Salinity or osmotic stress refers to a set of environmental conditions under which a plant will begin to suffer the effects of elevated salt concentration, such as ion imbalance, decreased stomatal conductance, decreased photosynthesis, decreased growth rate, increased cell death, loss of turgor (wilting), or ovule abortion. For these reasons, plants experiencing salinity stress typically exhibit a significant reduction in biomass and/or yield. Increases in growth rate in low-nitrogen conditions in plants can provide improved plant growth and initial establishment in geographic locales where plant's intake of nitrogenous fertilizers is often insufficient. Improvements in water use efficiency ensure better crop yield stability in drought years, and increased yield in regions with limited rainfall an irrigation. Increases in yield of plants can provide improved food quantity, or improved energy production. Increases in seed production in plants can provide improved nutritional availability in geographic locales where intake of plant foods is often insufficient, or for biofuel production.

In some embodiments, the abiotic stress tolerance level can be increased in a plant by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the abiotic stress tolerance level in a corresponding control plant that does not express the transgene. Abiotic stress tolerance can be assessed by described below or by other acceptable means.

Examples of modified characteristics include photosynthetic efficiency, seedling area, and biomass as it may be measured by plant height, leaf or rosette area, or dry mass. The modified characteristics may be observed and measured at different plant developmental stages, e.g. seed, seedling, bolting, senescence, etc. Often, abiotic stress tolerance can be expressed as ratios or combinations of measurements.

Biomass can include harvestable plant tissues such as leaves, stems, and reproductive structures, or all plant tissues such as leaves, stems, roots, and reproductive structures. In some embodiments, biomass encompasses only above ground plant parts. In some embodiments, biomass encompasses only stem plant parts. In some embodiments, biomass encompasses only above ground plant parts except inflorescence and seed parts of a plant. Biomass can be quantified as dry matter yield, which is the mass of biomass produced (usually reported in T/acre) if the contribution of water is subtracted from the fresh mater weight. Dry matter yield (DMY) yield is calculated using the fresh matter weight (FMW) and a measurement of weight percent moisture (M) in the following equation. DMY=((100−M)/100)*FMW. Biomass can be quantified as fresh matter yield, which is the mass of biomass produced (usually reported in T/acre) on an as-received basis, which includes the weight of moisture.

In some embodiments, a transgenic plant having exogenous nucleic acid expressing an abiotic stress tolerance increasing polypeptide can have increased levels of photosynthetic efficiency in seedlings. For example, the combinations of polypeptides described herein can be expressed in a transgenic plant, resulting in increased levels of photosynthetic efficiency in abiotic stress growth conditions. The level of photosynthetic efficiency can be increased by at least 0.25 percent, e.g., 0.25, 1, 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the level of photosynthetic efficiency in a corresponding control plant that does not express the abiotic stress tolerance-increasing polypeptide. In some cases, the increased levels of photosynthetic efficiency can be in one or more green tissues, e.g., leaves, stems, bulbs, flowers, fruits, young seeds. For example, the level of photosynthetic efficiency can be increased by at least 0.25 percent, e.g., 0.25, 1, 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the level of photosynthetic efficiency in a corresponding control plant that does not express the combination of transgenes.

In some embodiments, a transgenic plant provided herein can have increased growth rates in seedlings. For example, a combination of the polypeptides described herein can be expressed in a transgenic plant, resulting in increased growth rate in growth conditions of abiotic stress. The growth rate can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the growth rate in a corresponding control plant that does not express the combination. Growth rate can be measured in seedlings, developing, or mature plants and measured for periods of time such as about 1 hour, 3 hours, 6 hours, 12 hours, 1 day, 3 days, 5 days, 10 days, 1 month, 3 months, 6 months, 12 months, or the entire lifespan of a plant.

In some embodiments, a transgenic plant provided herein can have increased growth rates in one or more vegetative and reproductive tissues, e.g., leaves, stems, flowers, bulbs, fruits, young seeds. For example, the growth rate can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the growth rate in a corresponding control plant that does not express the transgene.

In some cases, a transgenic plant described herein and having enhanced yield stability can exhibit a height that is from about 5% to about 100% greater (e.g., about 5% to about 12%; about 5% to about 40%; about 5% to about 80%; about 7% to about 20%; about 10% to about 15%; about 10% to about 50%; about 10% to about 90%; about 20% to about 25%; about 20% to about 45%; about 20% to about 75%; about 25% to about 60%; about 25% to about 100%; about 30% to about 50%; about 30% to about 70%; about 40% to about 50%; about 45% to about 60%; about 50% to about 80%; about 55% to about 75%; about 60% to about 80%; about 60% to about 95%; about 75% to about 100%; about 80% to about 100%; about 90% to about 95%; or about 95% to about 100% greater) than a plant not expressing one or two of the polypeptides encoded by the exogenous nucleic acid when grown under abiotic stress conditions or following such conditions.

In some instances, a transgenic plant provided herein and having enhanced yield stability can exhibit greater leaf area or greater leaf length than a corresponding control plant (e.g., wild-type plant or a plant lacking at least one of the transgenes of the transgenic plant). For example, a transgenic plant can have a leaf area that is 5% to about 100% greater (e.g., about 5% to about 7%; about 5% to about 20%; about 8% to about 80%; about 10% to about 20%; about 10% to about 25%; about 10% to about 50%; about 10% to about 90%; about 15% to about 25%; about 20% to about 45%; about 20% to about 70%; about 25% to about 40%; about 25% to about 100%; about 30% to about 50%; about 30% to about 70%; about 40% to about 50%; about 45% to about 60%; about 50% to about 80%; about 55% to about 75%; about 60% to about 80%; about 60% to about 95%; about 75% to about 100%; about 80% to about 100%; about 90% to about 95%; or about 95% to about 100% greater) than a corresponding control plant when grown under abiotic stress or following such conditions.

A plant in which expression of an abiotic stress tolerance-increasing polypeptide is modulated can have increased levels of seed production. The level can be increased by at least 2 percent, e.g., 2, 3, 4, 5, 10, 15, 20, 25, 30, 35, 40, 45, 50, 55, 60, 65, 70, 75, 80, 85, 90, 95, 100, 110, 120, 130, 140, 150, 160, 170, 180, 190, or 200 percent or more, as compared to the seed production level in a corresponding control plant that does not express the transgene. Increases in seed production can provide improved nutritional availability in geographic locales where intake of plant foods is often insufficient, or for biofuel production.

In other cases, when a polypeptides described herein is expressed in a transgenic plant, the transgenic plant can exhibit enhanced yield stability and can exhibit a seed number (number of seeds per plant) from about 10% to about 95% greater (e.g., from about 10% to about 20%; from about 10% to about 50%; from about 10% to about 70%; from about 20% to about 60%; from about 20% to about 75%; from about 25% to about 85%; from about 30% to about 70%; from about 35% to about 90%; from about 40% to about 60%; from about 40% to about 85%; from about 50% to about 80%; from about 50% to about 90%; or from about 70% to about 90% greater) than a control plant not expressing the combination of polypeptides when grown under abiotic stress conditions. In certain cases, when a polypeptide described herein is expressed in a transgenic plant, the transgenic plant can exhibit enhanced yield stability and can exhibit an increase in seed weight per plant from about 5% to about 100% greater (e.g., about 5% to about 12%; about 5% to about 40%; about 5% to about 80%; about 7% to about 20%; about 10% to about 15%; about 10% to about 50%; about 10% to about 90%; about 20% to about 25%; about 20% to about 45%; about 20% to about 75%; about 25% to about 60%; about 25% to about 100%; about 30% to about 50%; about 30% to about 70%; about 40% to about 50%; about 45% to about 60%; about 50% to about 80%; about 55% to about 75%; about 60% to about 80%; about 60% to about 95%; about 75% to about 100%; about 80% to about 100%; about 90% to about 95%; or about 95% to about 100% greater) than the seed weight in a plant not expressing the polypeptide when grown under abiotic stress conditions.

Transgenic plants provided herein and having drought stress resistance can exhibit a lower transpiration rate compared to control plants of the same genetic background. Transpiration rate is a physiological parameter that is indicative of how well a plant can tolerate drought conditions. For example, plants with a low transpiration rate are expected to lose water more slowly than plants with higher transpiration rates and therefore would be expected to better withstand drought conditions (i.e., have better drought tolerance). When a polypeptide described herein is expressed in a transgenic plant, the transgenic plant can exhibit enhanced yield stability and can exhibit a transpiration rate that is reduced by about 0.25% to 100% (e.g., 0.27%, 0.3%, 0.43%, 0.55%, 0.7%, 0.99%, 1%, 2%, 4%, 6%, 8%, 10%, 12%, 15%, 18%, 22%, 28%, 35%, 37%, 42%, 45%, 47%, 50%, 55%, 64%, 68%, 71%, 75%, 77%, 80%, 83%, 86%, 89%, 90%, 92%, 95%, 98%, or 99%) as compared to the transpiration rate in a corresponding control plant when grown under drought conditions.

In some cases, a transgenic plant expressing a polypeptide described herein can exhibit enhanced yield stability and can exhibit a decreased change in photosynthetic activity ($\Delta Fv/Fm$) after exposure to abiotic stress conditions as compared to a corresponding control plant that does not express the polypeptides when grown under the same conditions. In some cases, a transgenic plant expressing a polypeptide described herein can exhibit enhanced yield stability and can exhibit an increased change in photosynthetic activity ($\Delta Fv/Fm\text{-}D_2$) post stress treatment as compared to a corresponding control plant when grown under the same conditions. For example, a transgenic plant expressing a polypeptide described herein can exhibit a $\Delta Fv/Fm$ of from about 0.1 to about 0.8 (e.g., about 0.2 to about 0.28; about 0.2 to about 0.32; about 0.22 to about 0.35; about 0.29 to about 0.4; about 0.3 to about 0.45; about 0.33 to about 0.41; about 0.35 to about 0.5; about 0.4 to about 0.8; about 0.46 to about 0.52; about 0.5 to about 0.65; about 0.5 to about 0.8; about 0.6 to about 0.7; about 0.6 to about 0.9; about 0.65 to about 0.75; about 0.7 to about 0.9; or about 0.75 to about 0.8) or a $\Delta Fv/Fm\text{-}D_2$ range of from about 0.03 to about 0.8 (e.g., about 0.03 to about 0.08; about 0.03 to about 0.032; about 0.04 to about 0.05; about 0.09 to about 0.4; about 0.05 to about 0.5; about 0.075 to about 0.1; about 0.08 to about 0.2; about 0.3 to about 0.45; about 0.33 to about 0.41; about 0.35 to about 0.5; about 0.4 to about 0.8; about 0.46 to about 0.52; about 0.5 to about 0.65; about 0.5 to about 0.8; about 0.6 to about 0.7; about 0.6 to about 0.9; about 0.65 to about 0.75; about 0.7 to about 0.9; about 0.75 to about 0.85; or about 0.8 to about 0.9). In some embodiments, photosynthetic activity can be reduced by about 0.25% to about 100% (e.g., about 0.25% to about 0.4%, about 0.25% to about 1%, about 0.25% to about 5%, about 0.5% to about 10%, about 1% to about 5%, about 1% to about 10%, about 2% to about 8%, about 3% to about 20%, about 5% to about 7%; about 5% to about 20%; about 5% to about 45%, about 8% to about 80%; about 10% to about 20%; about 10% to about 25%; about 10% to about 50%; about 10% to about 90%; about 15% to about 25%; about 20% to about 45%; about 20% to about 70%; about 25% to about 40%; about 25% to about 99%; about 30% to about 50%; about 30% to about 70%; about 40% to about 50%; about 45% to about 60%; about 50% to about 80%; about 55% to about 75%; about 60% to about 80%; about 60% to about 95%; about 75% to about 99%; about 80% to about 99%; about 90% to about 95%; or about 95% to about 100%) as compared to the photosynthetic activity in a corresponding control plant following abiotic stress conditions.

Typically, a difference in the amount of abiotic stress tolerance in a transgenic plant relative to a control plant is considered statistically significant at $p \leq 0.05$ with an appropriate parametric or non-parametric statistic, e.g., Chi-square test, Student's t-test, Mann-Whitney test, or F-test. In some embodiments, a difference in the amount of abiotic stress tolerance is statistically significant at $p<0.01$, $p<0.005$, or $p<0.001$. A statistically significant difference in, for example, the amount of abiotic stress tolerance in a transgenic plant compared to the amount of a control plant indicates that the recombinant nucleic acid present in the transgenic plant results in altered abiotic stress tolerance levels.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, S1 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

V. Modifying Endogenous Nucleic Acids Encoding Abiotic Stress Tolerance-Increasing Polypeptides This document also features plant cells and plants in which an endogenous abiotic stress tolerance-increasing nucleic acid described herein has been modified (e.g., a regulatory region, intron, or coding region of the abiotic stress tolerance-increasing nucleic acid has been modified). The abiotic stress tolerance of such plants is altered relative to the corresponding level of a control plant in which the endogenous nucleic acid is not modified. Such plants are referred to herein as modified plants and may be used to produce, for example, increased amounts of abiotic stress tolerance.

Endogenous nucleic acid can be modified by homologous recombination techniques. For example, sequence specific endonucleases (e.g., zinc finger nucleases (ZFNs)) and meganucleases can be used to stimulate homologous recombination at endogenous plant genes. See, e.g., Townsend et al., *Nature* 459:442-445 (2009); Tovkach et al., *Plant J.*, 57:747-757 (2009); and Lloyd et al., *Proc. Natl. Acad. Sci. USA*, 102:2232-2237 (2005). In particular, ZFNs engineered to create DNA double strand breaks at specific loci can be used to make targeted sequence changes in endogenous plant genes. For example, an endogenous plant gene can be replaced with a variant containing one or more mutations (e.g., produced using site-directed mutagenesis or directed evolution). In some embodiments, site directed mutagenesis is achieved via non-homologous end joining such that after breaking DNA, endogenous DNA repair mechanisms ligate the break, often introducing slight deletions or additions that can be screened at the cell or plant level for desired phenotypes. Moore and Haber, *Mol Cell Biol.,* 16(5):2164-73 (1996).

In some embodiments, endogenous nucleic acids can be modified by methylation or demethylation such that the expression of the modified endogenous nucleic acid is altered. For example, a double stranded RNA can be used to activate gene expression by targeting noncoding regulatory regions in gene promoters. See Shibuya et al., *Proc Natl Acad Sci USA,* 106(5): 1660-1665 (2009); and Li et al., *Proc Natl Acad Sci USA,* 103(46):17337-42 (2006). In some embodiments, ZFNs engineered to create DNA double strand breaks at specific loci can be used to insert a DNA fragment having at least one region that overlaps with the endogenous DNA to facilitate homologous recombination, such that the non-overlapping portion of the DNA fragment is integrated at the break site. For example, a fragment can be inserted into an endogenous promoter and/or regulatory region at a specific site where a ZFN creates a double stranded break to alter the expression of an endogenous gene. For example, a fragment that is inserted into an endogenous gene coding region at a specific site where a ZFN creates a double stranded break can result in expression of a chimeric gene. For example, a fragment that functions as a regulator region or promoter that is inserted into an endogenous DNA region immediately upstream of a gene coding sequence at a specific site where a ZFN creates a double stranded break can result in altered expression of the endogenous gene.

In some embodiments, endogenous nucleic acids can be modified using activation tagging. For example, a vector containing multiple copies of an enhancer element from the constitutively active promoter of the cauliflower mosaic virus (CaMV) 35S gene can be used to activate an endogenous gene. See, Weigel et al., *Plant Physiology,* 122:1003-1013 (2000).

In some embodiments, endogenous nucleic acids can be modified by introducing an engineered transcription activation/repression factor (e.g., zinc finger protein transcription factor, or ZFP TF. See, for example, the world wide web at sangamo.com/tech/tech_plat_over.html#whatarezfp). For example, a synthetic transcription facto sequence of a zinc finger DNA binding domain and a VP16 activation domain can be designed to bind to a specific endogenous DNA site and alter expression of an endogenous gene. An engineered transcription activation/repression factor (such as ZFP TF) can activate, repress, or switch the target endogenous abiotic stress tolerance gene expression by binding specifically to the promoter region or coding region of the endogenous gene. Engineered nucleases that cleave specific DNA sequences in vivo can also be valuable reagents for targeted mutagenesis. One such class of sequence-specific nucleases can be created by fusing transcription activator-like effectors (TALEs) to the catalytic domain of the FoId endonuclease. Both native and custom TALE-nuclease fusions direct DNA double-strand breaks to specific, targeted sites. Christian et al., *Genetics* 186: 757-761 (2010).

In some embodiments, endogenous nucleic acids can be modified by mutagenesis. Genetic mutations can be introduced within regenerable plant tissue using one or more mutagenic agents. Suitable mutagenic agents include, for example, ethyl methane sulfonate (EMS), N-nitroso-N-ethylurea (ENU), methyl N-nitrosoguanidine (MNNG), ethidium bromide, diepoxybutane, ionizing radiation, x-rays, UV rays and other mutagens known in the art. Suitable types of mutations include, for example, insertions or deletions of nucleotides, and transitions or transversions in the endogenous nucleic acid sequence. In one embodiment, TILLING (Targeted Induced Local Lesions In Genomes) can be used to produce plants having a modified endogenous nucleic acid. TILLING combines high-density mutagenesis with high-throughput screening methods. See, for example, McCallum et al., *Nat Biotechnol* 18: 455-457 (2000); reviewed by Stemple, *Nat Rev Genet* 5(2):145-50 (2004).

In some embodiments, an endogenous nucleic acid can be modified via a gene silencing technique. See, for example, the section herein regarding "Inhibition of Expression of an abiotic stress tolerance-Increasing Polypeptide."

A population of plants can be screened and/or selected for those members of the population that have a modified nucleic acid. A population of plants also can be screened and/or selected for those members of the population that have a trait or phenotype conferred by expression of the modified nucleic acid. As an alternative, a population of plants can be screened for those plants having a desired trait, such as a modulated level of abiotic stress tolerance. For example, a population of progeny can be screened for those plants having a desired level of expression of an abiotic stress tolerance-increasing polypeptide or nucleic acid. Physical and biochemical methods can be used to identify modified nucleic acids and/or expression levels as described with transgenic plants. Selection and/or screening can be carried out over one or more generations, and/or in more than one geographic location. In some cases, plants can be grown and selected under conditions which induce a desired phenotype or are otherwise necessary to produce a desired phenotype in a modified plant. In addition, selection and/or screening can be applied during a particular developmental stage in which the phenotype is expected to be exhibited by the plant. Selection and/or screening can be carried out to choose those modified plants having a statistically significant difference in an abiotic stress tolerance level relative to a control plant in which the nucleic acid has not been modified. Selected or screened modified plants have an altered phenotype as compared to a corresponding control plant, as described in the "Transgenic Plant Phenotypes" section herein.

Although a plant or plant cell in which an endogenous abiotic stress tolerance-increasing nucleic acid has been modified is not transgenic for that particular nucleic acid, it will be appreciated that such a plant or cell may contain transgenes. For example, a modified plant can contain a transgene for other traits, such as herbicide tolerance or insect resistance. As another example, a modified plant can contain one or more transgenes that, in conjunction with modifications of one or more endogenous nucleic acids, exhibits an increase in abiotic stress tolerance.

As with transgenic plant cells, modified plant cells can constitute part or all of a whole plant. Such plants can be grown in the same manner as described for transgenic plants and can be bred or propagated in the same manner as described for transgenic plants.

VI. Plant Breeding

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. For example, PCR techniques can be used to enzymatically amplify a genetic marker associated with a nucleotide sequence conferring a specific trait (e.g., nucleotide sequences described herein). PCR can be used to amplify specific sequences from DNA as well as RNA, including sequences from total genomic DNA or total cellular RNA. When using RNA as a source of template, reverse transcriptase can be used to synthesize complementary DNA (cDNA) strands. Various PCR methods are described, for example, in *PCR Primer: A Laboratory Manual*, Dieffenbach and Dveksler, eds., Cold Spring Harbor Laboratory Press, 1995.

Generally, sequence information from polynucleotides flanking the region of interest or beyond is employed to design oligonucleotide primers that are identical or similar in sequence to opposite strands of the template to be amplified. Primers are typically 14 to 40 nucleotides in length, but can range from 10 nucleotides to hundreds of nucleotides in length. Template and amplified DNA is repeatedly denatured at a high temperature to separate the double strand, then cooled to allow annealing of primers and the extension of nucleotide sequences through the microsatellite, resulting in sufficient DNA for detection of PCR products. If the probes flank an SSR in the population, PCR products of different sizes will be produced. See, e.g., U.S. Pat. No. 5,766,847.

PCR products can be qualitative or quantitatively analyzed using several techniques. For example, PCR products can be stained with a fluorescent molecule (e.g., PicoGreen® or OliGreen®) and detected in solution using spectrophotometry or capillary electrophoresis. In some cases, PCR products can be separated in a gel matrix (e.g., agarose or polyacrylamide) by electrophoresis, and size-fractionated bands comprising PCR products can be visualized using nucleic acid stains. Suitable stains can fluoresce under UV light (e.g., Ethidium bromide, GR Safe, SYBR® Green, or SYBR® Gold). The results can be visualized via transillumination or epi-illumination, and an image of the fluorescent pattern can be acquired using a camera or scanner, for example. The image can be processed and analyzed using specialized software (e.g., ImageJ) to measure and compare the intensity of a band of interest against a standard loaded on the same gel.

Alternatively, SSR polymorphisms can be identified by using PCR product(s) as a probe against Southern blots from different individuals in the population. See, U. H. Refseth et al., (1997) *Electrophoresis* 18: 1519. Briefly, PCR products are separated by length through gel electrophoresis and transferred to a membrane. SSR-specific DNA probes, such as oligonucleotides labeled with radioactive, fluorescent, or chromogenic molecules, are applied to the membrane and hybridize to bound PCR products with a complementary nucleotide sequence. The pattern of hybridization can be visualized by autoradiography or by development of color on the membrane, for example.

In some cases, PCR products can be quantified using a real-time thermocycler detection system. For example, Quantitative real-time PCR can use a fluorescent dye that forms a DNA-dye-complex (e.g., SYBRR Green), or a fluorophore-containing DNA probe, such as single-stranded oligonucleotides covalently bound to a fluorescent reporter or fluorophore (e.g. 6-carboxyfluorescein or tetrachlorofluorescin) and quencher (e.g., tetramethylrhodamine or dihydrocyclopyrroloindole tripeptide minor groove binder). The fluorescent signal allows detection of the amplified product in real time, thereby indicating the presence of a sequence of interest, and allowing quantification of the copy number of a sequence of interest in cellular DNA or expression level of a sequence of interest from cellular mRNA.

The identification of RFLPs is discussed, for example, in Alonso-Blanco et al. (*Methods in Molecular Biology*, vol. 82, "*Arabidopsis* Protocols", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; and Gardiner, J. et al., (1993) *Genetics* 134: 917). For example, to produce a RFLP library enriched with single- or low-copy expressed sequences, total DNA can be digested with a methylation-sensitive enzyme (e.g., PstI). The digested DNA can be separated by size on a preparative gel. Polynucleotide fragments (500 to 2000 bp) can be excised, eluted and cloned into a plasmid vector (e.g., pUC18). Southern blots of plasmid digests can be probed with total sheared DNA to select clones that hybridize to single- and low-copy sequences. Additional restriction endonucleases can be tested to increase the number of polymorphisms detected.

The identification of AFLPs is discussed, for example, in EP 0 534 858 and U.S. Pat. No. 5,878,215. In general, total cellular DNA is digested with one or more restriction enzymes. Restriction halfsite-specific adapters are ligated to all restriction fragments and the fragments are selectively amplified with two PCR primers that have corresponding adaptor and restriction site specific sequences. The PCR products can be visualized after size-fractionation, as described above.

In some embodiments, the methods are directed to breeding a plant line. Such methods use genetic polymorphisms identified as described above in a marker assisted breeding program to facilitate the development of lines that have a desired alteration in the abiotic stress tolerance trait. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VII. Articles of Manufacture

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein produce higher yields of grain and/or biomass per hectare, relative to control plants that lack the exogenous nucleic acid or lack the modified endogenous nucleic acid when grown on soils with elevated abiotic stress levels. For example, transgenic plants described herein can have a grain yield that is increased about 5% to about 20% (e.g., increased 5% to 10%, 5% to 15%, 10% to 15%, 10% to 20%, or 15% to 20%) relative to that of control plants lacking the exogenous nucleic acid or lacking the modified endogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as elevated abiotic stress levels.

In some embodiments, plants described herein have a composition that permits more efficient processing into free sugars, and subsequently ethanol, for energy production. In some embodiments, such plants provide higher yields of ethanol, butanol, dimethyl ether, other biofuel molecules, and/or sugar-derived co-products per kilogram of plant material, relative to control plants. Such processing efficiencies are believed to be derived from the composition of the plant material, including, but not limited to, content of glucan, cellulose, hemicellulose, and lignin. By providing higher yields at an equivalent or even decreased cost of production, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

The invention will be further described in the following examples, which do not limit the scope of the invention described in the claims.

EXAMPLES

Example 1

Production of Transgenic Rice Plants

Transformed Indica IR64 rice plants were made both with and without selection markers. Marker-free (MF) plants were made by co-transforming distinct binary vectors for expressing either the selection marker gene neomycin phosphotransferase (NPT II) or the transgene of interest. The regenerated plants were then selfed, and marker-free segregants positive for the transgene of interest were selected for testing. Some plants (M+) were made by transformation with single binary vectors expressing both the marker selection gene and the transgene of interest, and thus the transformed plants retained the marker.

Immature embryos of Indica rice variety IR64 were harvested, transformed, selected, and the transgenic plants regenerated using established methods (see U.S. Pat. No. 6,329,571). Transformation was verified and followed in subsequent generations by PCR.

The plants tested are shown in Table 1. Ninety-five (95) independent transformation events were generated and tested.

TABLE 1

Transgenic Indica rice plants tested.

| Transformant designation | Promoter | Encoded polypeptide | Marker Free events | Marker + events |
|---|---|---|---|---|
| OsIB-1805402 | PD2995 (SEQ ID NO 21 in WO2009099899) | SEQ ID NO 2 | 5 | 12 |
| OsIB-872104m | PD3317 (SEQ ID NO 404) | SEQ ID NO 337 | 7 | 5 |
| OsIB-26006 | PD3562 (SEQ ID NO 5 in WO2009146015) | SEQ ID NO 61 | 24 | 2 |
| OsIB-375578m | PD3141 (SEQ ID NO 23 in WO2009099899) | SEQ ID NO 205 | 11 | 8 |
| OsIB-625057 | PD3141 | SEQ ID NO 27 | 4 | 3 |
| OsIB-878355 | PD3141 | SEQ ID NO 209 | 3 | 3 |
| OsIB-258841 | PD3141 | SEQ ID NO 370 | 3 | 5 |

Example 2

Abiotic Stress Tests

Forty (40) day old seedlings of the transgenic events plus untransformed IR64 controls were planted in the test plot, for testing in random block design with three replicates, under each of the six abiotic stress conditions described below. Planting density was 20×15 cm.

For drought stress D1, watering ceased about 15 days before flowering. The stress was imposed for 15-18 days, and then released at the post flowering stage. For drought stress D2, watering ceased post flowering, and the stress was maintained for until maturity.

For salinity stress tests S1 and S2, the test plots were irrigated with a sodium chloride solution from the seedling to maturity stages. For the S1 test, soil electrical conductivity (EC) was maintained between 4 and 5 deciSiemens per meter (dS/m), and for the S2 test, the EC was between 6 and 7 dS/m.

For the nitrogen deficiency stress assays N1 and N2, fertilizer was applied in three doses at different growth stages from seedling to maturity at total rates of 50 and 75 kg Nitrogen per hectare respectively, i.e., at one half and three quarters the normal rate respectively.

Example 3

Results of Abiotic Stress Tests

Grain was harvested from mature plants, and grain weight per plant was recorded for five plants from each replicate in all treatments. Tables 2-7 show yield results for plants with yield performance statistically superior to the respective controls. In Tables 2-7, suffixes of transformant designations denote distinct transformation events.

TABLE 2

Results of the D1 test; Least Significant Difference at $p < 0.01$ for IR64 control (LSD) is 5.15

| Plant | Yield (grams per plant) | % higher than IR64 |
|---|---|---|
| IR 64 | 8.39 | n/a |
| OSIB-625057-MF-004 | 16.88 | 101.19 |
| OSIB-878355-M+004 | 15.28 | 82.12 |
| OSIB-878355-M+005 | 13.80 | 64.48 |
| OSIB-878355-MF-002 | 17.82 | 112.40 |
| OsIB-258841-M+005 | 16.96 | 102.15 |
| OSIB375578M-M+019 | 16.80 | 100.24 |
| OSIB375578M-MF-006 | 17.31 | 106.32 |
| OSIB375578M-MF-009 | 18.35 | 118.71 |
| OSIB375578M-MF-010 | 16.22 | 93.33 |
| OsIB-872104m-MF-005 | 18.74 | 123.36 |
| OSIB-26006-M+025 | 18.01 | 114.66 |
| OSIB-26006-M+026 | 20.27 | 141.60 |
| OSIB-26006-MF-004 | 17.92 | 113.59 |
| OSIB-26006-MF-006 | 18.23 | 117.28 |
| OSIB-26006-MF-009 | 18.90 | 125.27 |
| OSIB-26006-MF-010 | 14.27 | 70.08 |
| OSIB-26006-MF-016 | 15.97 | 90.35 |
| OSIB-26006-MF-019 | 13.74 | 63.77 |
| OSIB-26006-MF-023 | 18.32 | 118.36 |
| OSIB-1805402-M+012 | 15.82 | 88.56 |
| OSIB-1805402-M+017 | 14.12 | 68.30 |

TABLE 3

Results of the D2 test; LSD = 1.809

| Plant | Yield (grams per plant) | % higher than IR64 |
|---|---|---|
| IR 64 | 2.48 | n/a |
| OSIB-878355-M+004 | 6.23 | 151.21 |
| OsIB-258841-M+005 | 5.82 | 134.68 |
| OSIB375578M-M+014 | 10.49 | 322.98 |
| OSIB375578M-MF-001 | 5.15 | 107.66 |
| OSIB375578M-MF-006 | 5.26 | 112.10 |
| OSIB375578M-MF-010 | 4.56 | 83.87 |
| OSIB-872104m-M+008 | 5.39 | 117.34 |
| OSIB-872104m-MF-002 | 4.28 | 72.58 |
| OSIB-26006-MF-001 | 5.02 | 102.42 |
| OSIB-26006-MF-002 | 5.59 | 125.40 |
| OSIB-26006-MF-003 | 5.68 | 129.03 |
| OSIB-26006-MF-004 | 5.92 | 138.71 |
| OSIB-26006-MF-009 | 5.50 | 121.77 |
| OSIB-26006-MF-010 | 4.57 | 84.27 |
| OSIB-26006-MF-011 | 4.79 | 93.15 |
| OSIB-26006-MF-013 | 6.42 | 158.87 |
| OSIB-26006-MF-017 | 4.90 | 97.58 |
| OSIB-26006-MF-018 | 6.27 | 152.82 |
| OSIB-26006-MF-019 | 5.78 | 133.06 |
| OSIB-1805402-M+010 | 5.26 | 112.10 |
| OSIB-1805402-M+017 | 6.04 | 143.55 |

TABLE 4

Results of the S1 test; LSD = 2.82

| Plant | Yield (grams per plant) | % higher than IR64 |
|---|---|---|
| IR 64 | 4.02 | n/a |
| OsIB-258841-M+005 | 7.57 | 88.31 |
| OsIB-258841-M+008 | 7.48 | 86.07 |
| OSIB375578M-M+014 | 9.75 | 142.54 |
| OSIB375578M-M+019 | 9.28 | 130.85 |
| OSIB375578M-MF-010 | 7.56 | 88.06 |
| OSIB-872104m-M+008 | 6.86 | 70.65 |
| OSIB-872104m-M+010 | 13.53 | 236.57 |
| OSIB-872104m-MF-002 | 6.80 | 69.15 |
| OSIB-872104m-MF-003 | 7.57 | 88.31 |
| OSIB-872104m-MF-006 | 7.19 | 78.86 |
| OSIB-26006-MF-001 | 9.31 | 131.59 |
| OSIB-26006-MF-002 | 8.80 | 118.91 |
| OSIB-26006-MF-003 | 9.04 | 124.88 |
| OSIB-26006-MF-006 | 10.02 | 149.25 |
| OSIB-26006-MF-009 | 10.23 | 154.48 |
| OSIB-26006-MF-010 | 8.41 | 109.20 |
| OSIB-26006-MF-011 | 7.28 | 81.09 |
| OSIB-26006-MF-012 | 7.38 | 83.58 |
| OSIB-26006-MF-013 | 11.16 | 177.61 |
| OSIB-26006-MF-016 | 6.91 | 71.89 |
| OSIB-26006-MF-021 | 7.13 | 77.36 |
| OSIB-1805402-M+009 | 9.00 | 123.88 |
| OSIB-1805402-M+010 | 9.23 | 129.60 |
| OSIB-1805402-M+012 | 9.07 | 125.62 |
| OSIB-1805402-M+013 | 8.63 | 114.68 |
| OSIB-1805402-M+017 | 7.71 | 91.79 |
| OSIB-1805402-MF-003 | 8.68 | 115.92 |
| OSIB-1805402-MF-004 | 7.45 | 85.32 |

TABLE 5

Results of the S2 test; LSD = 2.66

| Plant | Yield (grams per plant) | % higher than IR64 |
|---|---|---|
| IR 64 | 3.09 | n/a |
| OsIB-258841-M+008 | 5.84 | 89.00 |
| OSIB375578M-M+014 | 7.15 | 69.52 |
| OSIB375578M-M+015 | 6.11 | 42.24 |
| OSIB375578M-M+016 | 6.26 | 51.88 |
| OSIB375578M-M+018 | 6.64 | 56.71 |
| OSIB375578M-MF-006 | 6.78 | 55.57 |
| OSIB375578M-MF-010 | 11.04 | 117.26 |
| OSIB-872104m-MF-003 | 10.48 | 66.94 |
| OSIB-872104m-MF-005 | 6.02 | 27.96 |
| OSIB-872104m-MF-007 | 8.77 | 94.35 |
| OSIB-26006-M+026 | 6.15 | 34.89 |
| OSIB-26006-MF-004 | 8.10 | 81.46 |
| OSIB-26006-MF-006 | 9.00 | 72.96 |
| OSIB-26006-MF-008 | 5.74 | 29.44 |
| OSIB-26006-MF-009 | 7.47 | 76.31 |
| OSIB-26006-MF-011 | 6.80 | 49.67 |
| OSIB-26006-MF-013 | 6.82 | 54.85 |
| OSIB-26006-MF-017 | 7.98 | 71.70 |
| OSIB-1805402-M+012 | 7.40 | 54.01 |
| OSIB-1805402-M+017 | 7.33 | 57.30 |
| OSIB-1805402-MF-003 | 8.41 | 72.58 |
| OSIB-1805402-MF-004 | 5.91 | 33.53 |

TABLE 6

Results of the N1 test; LSD = 4.07

| Plant | Yield (grams per plant) | % higher than IR64 |
|---|---|---|
| IR 64 | 8.58 | n/a |
| OSIB-625057-M+005 | 13.68 | 59.44 |
| OSIB-625057-M+006 | 15.75 | 83.57 |
| OSIB-625057-M+007 | 12.81 | 49.30 |
| OSIB-625057-MF-003 | 17.96 | 109.32 |

TABLE 6-continued

Results of the N1 test; LSD = 4.07

| Plant | Yield (grams per plant) | % higher than IR64 |
|---|---|---|
| OSIB-878355-M+004 | 14.82 | 72.73 |
| OSIB-878355-M+005 | 17.01 | 98.25 |
| OSIB-878355-MF−001 | 15.11 | 76.11 |
| OSIB-878355-MF−002 | 17.15 | 99.88 |
| OsIB-258841-M+005 | 15.86 | 84.85 |
| OsIB-258841-M+006 | 19.97 | 132.75 |
| OsIB-258841-M+008 | 21.82 | 154.31 |
| OSIB375578M-M+016 | 13.89 | 61.89 |
| OSIB375578M-M+018 | 19.46 | 126.81 |
| OSIB375578M-MF−001 | 14.54 | 69.46 |
| OSIB375578M-MF−002 | 15.11 | 76.11 |
| OSIB375578M-MF−004 | 15.79 | 84.03 |
| OSIB375578M-MF−010 | 14.93 | 74.01 |
| OSIB-872104m-M+008 | 15.70 | 82.98 |
| OSIB-872104m-M+009 | 13.40 | 56.18 |
| OSIB-872104m-M+010 | 14.25 | 66.08 |
| OSIB-872104m-MF−002 | 16.96 | 97.67 |
| OSIB-872104m-MF−003 | 13.71 | 59.79 |
| OSIB-872104m-MF−004 | 15.74 | 83.45 |
| OSIB-872104m-MF−005 | 15.22 | 77.39 |
| OSIB-872104m-MF−007 | 13.19 | 53.73 |
| OSIB375578M-MF−006 | 18.06 | 110.49 |
| OSIB-26006-MF−002 | 13.84 | 61.31 |
| OSIB-26006-MF−003 | 13.68 | 59.44 |
| OSIB-26006-MF−004 | 16.80 | 95.80 |
| OSIB-26006-MF−006 | 16.01 | 86.60 |
| OSIB-26006-MF−008 | 16.11 | 87.76 |
| OSIB-26006-MF−009 | 17.22 | 100.70 |
| OSIB-26006-MF−010 | 13.82 | 61.07 |
| OSIB-26006-MF−011 | 14.93 | 74.01 |
| OSIB-26006-MF−013 | 14.26 | 66.20 |
| OSIB-26006-MF−014 | 13.48 | 57.11 |
| OSIB-26006-MF−016 | 12.77 | 48.83 |
| OSIB-26006-MF−018 | 13.18 | 53.61 |
| OSIB-26006-MF−019 | 16.51 | 92.42 |
| OSIB-26006-M+025 | 14.20 | 65.50 |
| OSIB-1805402-M+007 | 14.07 | 63.99 |
| OSIB-1805402-M+009 | 17.73 | 106.64 |
| OSIB-1805402-M+012 | 13.14 | 53.15 |
| OSIB-1805402-M+017 | 17.51 | 104.08 |
| OSIB-1805402-MF−003 | 15.89 | 85.20 |
| OSIB-1805402-MF−004 | 12.80 | 49.18 |

TABLE 7

Results of the N2 test; LSD = 3.6609

| Plant | Yield (grams per plant) | % higher than IR64 |
|---|---|---|
| IR 64 | 5.99 | n/a |
| OSIB-878355-M+005 | 10.72 | 78.96 |
| OsIB-258841-M+005 | 13.16 | 119.70 |
| OsIB-258841-M+008 | 11.07 | 84.81 |
| OSIB375578M-M+018 | 10.09 | 68.45 |
| OSIB375578M-MF−001 | 9.90 | 65.28 |
| OSIB375578M-MF−006 | 10.19 | 70.12 |
| OSIB375578M-MF−010 | 9.58 | 59.93 |
| OSIB-26006-MF−010 | 10.24 | 70.95 |
| OSIB-1805402-M+009 | 11.24 | 87.65 |
| OSIB-1805402-M+017 | 9.97 | 66.44 |

Example 4

Determination of Functional Homologs by Reciprocal BLAST

A candidate sequence was considered a functional homolog of a reference sequence if the candidate and reference sequences encoded proteins having a similar function and/or activity. A process known as Reciprocal BLAST (Rivera et al., *Proc. Natl. Acad. Sci. USA*, 95:6239-6244 (1998)) was used to identify potential functional homolog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NOs: 2, 337, 61, 111, 27, 209, and 370 are shown in FIGS. 1-7, respectively. Additional exemplary homologs are correlated to certain Figures in the Sequence Listing.

Example 5

Determination of Functional Homologs by Hidden Markov Models

Hidden Markov Models (HMMs) were generated by the program HMMER 3.0. To generate each HMM, the default HMMER 3.0 program parameters were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO: 2.

The procedure above was repeated and an HMM was generated for each group of sequences shown in FIGS. 2-7, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (404 sequences)

SEQ ID NO: 1 - DNA, 1090 bp, Panicum virgatum
  misc_feature (1)..(1090): Ceres Clone ID no. 1805402
  misc_feature (1)..(1090): Encodes the peptide sequence at SEQ ID NO. 2
accagttcccgctcagttcaaagcagcagcgcctcgccatcatcagagacaaacacacgagctcagagaaggaaacaccacacgcatgaccaacggcatcttctccgccatggcaggggaccaagcgtacatgatccgattcgacggccacttcgacgacacctcgccgagctccgccggcgccgagccgccggaggtgcaggtgcaggtgcagcagccgccgccgttcgcggggcgggtgatctcccccgagcaggagcaccaggtcattgtcaccgccctgctgcacgtcgtctccgggtacacaaccgcgccgccggagatcttcccgcccgccgccgcggcgtgccgggtgtgcgggatggagcggtgcctcggctgcgagggcgccgcggcgatcgcattggacggcgcggagagcaatgcggccgcggcgccgggcgcggcagggcagaggaggcggaggaagaagaagaacaagtaccgcggcgtgcgccagcggccgtgggggaagtgggcggcggagatccgcgacccgcgccgcgcggtgcgcaagtggctcgggacgttcgacaccgccgaggaggccgccaaggcgtacgaccgcgccgccgtcgagttccgcggcccgcgcgccaagctcaacttcccgttccccgagcaggccgcggggcgcgacgaggccaccagcaacggcgacgcgagcgcggccgccaggtcctcggacaacacgctgtcgccgtcgctctgcagcggggacgccgaggagcgggggcagccggcggagtggccgcggggcggggggcaggaaacaggggagcagctctgggaaggcctccaggacctgatgaggctggacgaagccgagctctggttcccgccaacttccaacgcttggaattgaaacgtacgcgcgattagatcctagccgttcaagcggttccaaaatgaacatcctagcctttcgatgtgacttttttttttccagctctgttgtgcttatttgatcatagcagagttttgtaaattacctgtagagtccaaccaactgtattaatcaggcaattttgggagtgtgcctttctaccgc

SEQ ID NO: 2 - protein, 272 aa, Panicum virgatum
  misc_feature (1)..(272): Ceres Clone ID no. 1805402
  misc_feature (1)..(272): Bit score of 332.5 for HMM based on sequences of Figure 1
  misc_feature (56)..(78): Name: CMX-1
  misc_feature (88)..(99): Name: CMX-2
  misc_feature (132)..(181): Pfam Name: AP2 Pfam Description: AP2 domain
MTNGIFSAMAGDQAYMIRFDGHFDDTSPSSAGAEPPEVQVQVQQPPPFAGRVISPEQEHQVIVTALLHVVSGYTTAPPEIFPPAAAACRVCGMERCLGCEGAAAIALDGAESNAAAAPGAAGQRRRRKKKNKYRGVRQRPWGKWAAEIRDPRRAVRKWLGTFDTAEEAAKAYDRAAVEFRGPRAKLNFPFPEQAAGRDEATSNGDASAAARSSDNTLSPSLCSGDAEERGQPAEWPRGGGQETGEQLWEGLQDLMRLDEAELWFPPTSNAWN

SEQ ID NO: 3 - DNA, 1027 bp, Zea mays
  misc_feature (1)..(1027): Ceres Clone ID no. 278992
  misc_feature (1)..(1027): Encodes the peptide sequence at SEQ ID NO. 4
cagttcaaagcagcgcctcgccaccggacgaacacacagatcgctacagcccgcatgaccaacctctccgccatggcagcgagccaatcctacgtgatccgattcgacggccacttcgacgagccgtcgccgagctccgcgggcgccgagccgccgggcccgcagccgccgttcgcagggaggatgatctcgctcgagcgggagcaccaagtcattgtcgccgccctgctgcacgtcgtctccgggtacgccacgccgccgccgcaggtcttcacgccgccgccggcagcggcgcgctgccaggtgtgcgggatggagcggtgcctcggctgcgagttcttcgccgccggggagggcgcattgggcggcggcgcggagaaggcagccgcgacaggaggcgcggcggcgctggcggcggggcaaaggaggcggaggaagaagaagaacaagtaccgcggcgtgcggcagcggccgtgggggaagtgggcggcggagatccgcgacccgcgccgcgcggtgcgcaagtggctgggcacgttcgacaccgccgaggaggccgccagggcctacgaccaggccgccatcgagttccgcggcccgcgcgccaagctcaacttcccgttccccgagcagccgccgacggggcacgacgagcccatcagcagcaacggcgacgcgagcgcggccgccaggtcgtcggacaccacgccgtcgccgtcgctctgcagcgcggacgccgaggagcgcgggcagccggagtggccgagcgccgggcaggaggcaggggaccaactgctctgggaaggcctgcaggacctgatgaggctggacgaaggcgagccctggctccatccagcctcaagcgcttggaattgaaatttgaaacgcccgcgatcagatcccagccgttcaactagtttgaaataggagcatcctagcctttcgctatgcttctttttttttcttccctccttaactcttctttttctaacctctgttgtacttatttggacaaagcagagttttg

SEQ ID NO: 4 - protein, 273 aa, Zea mays
  misc_feature (1)..(273): Ceres Clone ID no. 278992
  misc_feature (1)..(273): Bit score of 327.4 for HMM based on sequences of Figure 1
  misc_feature (1)..(273): Functional Homolog Of SEQ ID NO. 2
  misc_feature (48)..(70): Name: CMX-1
  misc_feature (82)..(93): Name: CMX-2
  misc_feature (132)..(181): Pfam Name: AP2 Pfam Description: AP2 domain
MTNLSAMAASQSYVIRFDGHFDEPSPSSAGAEPPGPQPPFAGRMISLEREHQVIVAALLHVVSGYATPPPQVFTPPPAAARCQVCGMERCLGCEFFAAGEGALGGGAEKAAATGGAAALAAGQRRRRKKKNKYRGVRQRPWGKWAAEIRDPRRAVRKWLGTFDTAEEAARAYDQAAIEFRGPRAKLNFPFPEQPPTGHDEPISSNGDASAAARSSDTTPSPSLCSADAEERGQPEWPSAGQEAGDQLLWEGLQDLMRLDEGEPWLHPASSAWN

SEQ ID NO: 5 - DNA, 891 bp, Sorghum bicolor
  misc_feature (1)..(891): Ceres Annot ID no. 6014857
  misc_feature (1)..(891): Encodes the peptide sequence at SEQ ID NO. 6
atgaccaaccgcgccttctccgccatggcagcgagccaccaatcatcctacatgatccgattcgacggcgcccactccgacgacccgtcgccgagctccgccggcgccgagccgccgggccccgcgcagccgcagccgcagccgcagccaccgttcgcggggcggaggatgatctcccccgagcaggagcaccaagtcattgtcgccgccctgctccacgtcgtctccgggtacaccacgccgccgccggaggtcttcccgcctccaccgccgccgacagcggcgtgctgccagctgtgcgggatggagcggtgcctcggctgcgagttcttcgccgccgccggggagggctgcttattaccagcgacgaccgcattggacggcgcggggaaggcagtggccgcggcgacaagcgcggcgccggggcagaggaggcggaggaagaagaagaacaagtaccgcggcgtgcggcagcggccgtgggggaagtgggcggcggagatccgcgacccgcgccgcgccgtgcgcaagtggctgggcacgttcgacaccgccgaggaggccgccagggcgtacgaccaggccgccatcgagttccgcggcccgcgcgccaagctcaacttcccgttccccgagcagctggcgacgggcacgggccacgacgaggccagcgcggccgccaccaccaagtcgtcggacaacacgctgtcgctgtcgccgtcgctctgcagcgacgagcgggagcgggagcgggggcagccggagtggctgccgagcgccgggctcggagggcaggaaacaggggagcagctctgggaaggcctgcaggacttgatgaagctggacgaaggcgagctctggttcccgccaacctcgagcgcttggaattga

SEQ ID NO: 6 - protein, 296 aa, Sorghum bicolor
  misc_feature (1)..(296): Ceres Annot ID no. 6014857
  misc_feature (1)..(296): Bit score of 336.2 for HMM based on sequences of Figure 1
  misc_feature (1)..(296): Functional Homolog Of SEQ ID NO. 2
  misc_feature (61)..(83): Name: CMX-1
  misc_feature (97)..(108): Name: CMX-2
  misc_feature (152)..(201): Pfam Name: AP2 Pfam Description: AP2 domain
MTNRAFSAMAASHQSSYMIRFDGAHSDDPSPSSAGAEPPGPAQPQPQPQPPFAGRRMISPEQEHQVIVAALLHVVSGYTTPPPEVFPPPPPPTAACCQLCGMERCLGCEFFAAAGEGCLLPATTALDGAGKAVAAATSAAPGQRRRRKKKNKYRGVRQRPWGKWAAEIRDPRRAVRKWLGTFDTAEEAARAYDQAAIEFRGPRAKLNFPFPEQLATGTGHDEASAAATTKSSDNTLSLSPSLCSDERERERGQPEWLPSAGLGGQETGEQLWEGLQDLMKLDEGELWFPPTSSAWN

SEQ ID NO: 7 - DNA, 849 bp, Oryza sativa
  misc_feature (1)..(849): Ceres Annot ID no. 6318302
  misc_feature (1)..(849): Encodes the peptide sequence at SEQ ID NO. 8
atgaccaaccggatctccgccatgggaggcaaccaggagtacatgatccgattcgacggccacatcgacgatgcctcgccgagctccgccactgcagagccaccgccgccgctgccgccgccgcgtcccttcgccgggagggcgatctcggccgagagggagcactctgtgatcgtcgcgacgctgctccatgtcatctccggctacaggacgccgccgccggaggtgttcccggcggcgcgcgcggaggtgtgcggggtttgcgggatggaccagtgcctcgggtgcgagttcttcgccggggagtccggggtggtgtcgttcgatggcgcggagaaggtggcggcggcggccgccgcggcggcggctggcgccgcggcggggcagaggaggaggaggaagaagaagaacaagtaccgcggcgtgcggcagcggccatgggggaagtgggctgcggagatccgcgaccctcgccgagcggtgcgcaagtggctggggacgttcgacaccgccgaggaggccgccagggcgtacgaccgcgccgccgtcgagttccgcggcccgcgcgccaagctcaacttcccgttccccgagcagctctccgcgcacgacgacagcaatggcgacgccagcgccgccgccaagtccgacacattgtctccgtcgccgcgcagcgcagacgccgacgagcaagtagagcacacgcggtggccgcagggaggaggaggcggcggcggcggcggcggcggcgagacaggggaccagctctgggaaggcttgcaagacctgatgcagctggacgaaggcgggctcagctggttcccacagtcgtcagattcttggaattga

SEQ ID NO: 8 - protein, 282 aa, Oryza sativa
  misc_feature (1)..(282): Ceres Annot ID no. 6318302
  misc_feature (1)..(282): Bit score of 346.1 for HMM based on sequences of Figure 1
  misc_feature (1)..(282): Functional Homolog Of SEQ ID NO. 2
  misc_feature (52)..(74): Name: CMX-1
  misc_feature (85)..(96): Name: CMX-2
  misc_feature (138)..(187): Pfam Name: AP2 Pfam Description: AP2 domain
MTNRISAMGGNQEYMIRFDGHIDDASPSSATAEPPPPLPPPRPFAGRAISAEREHSVIVATLLHVISGYRTPPPEVFPAARAEVCGVCGMDQCLGCEFFAGESGVVSFDGAEKVAAAAAAAAAGAAAGQRRRRKKKNKYRGVRQRPWGKWAAEIRDPRRAVRKWLGTFDTAEEAARAYDRAAVEFRGPRAKLNFPFPEQLSAHDDSNGDASAAAKSDTLSPSPRSADADEQVEHTRWPQGGGGGGGGGGGETGDQLWEGLQDLMQLDEGGLSWFPQSSDSWN

SEQ ID NO: 9 - protein, 275 aa, Oryza sativa
  misc_feature (1)..(275): Public GI ID no. 125603736
  misc_feature (1)..(275): Oryza sativa Japonica Group
  misc_feature (1)..(275): Bit score of 345.8 for HMM based on sequences of Figure 1
  misc_feature (1)..(275): Functional Homolog Of SEQ ID NO. 2
  misc_feature (131)..(180): Pfam Name: AP2 Pfam Description: AP2 domain
MGGNQEYMIRFDGHIDDASPSSATAEPPPPLPPPRPFAGRAISAEREHSVIVATLLHVISGYRTPPPEVFPAARAEVCGVCGMDQCLGCEFFAGESGVVSFDGAEKVAAAAAAAAAGAAAGQRRRRKKKNKYRGVRQRPWGKWAAEIRDPRRAVRKWLGTFDTAEEAARAYDRAAVEFRGPRAKLNFPFPEQLSAHDDSNGDASAAAKSDTLSPSPRSADADEQVEHTRWPQGGGGGGGGGGGETGDQLWEGLQDLMQLDEGGLSWFPQSSDSWN

SEQ ID NO: 10 - protein, 279 aa, Brachypodium distachyon
  misc_feature (1)..(279): Public GI ID no. 357148089
  misc_feature (1)..(279): Bit score of 332.0 for HMM based on sequences of Figure 1
  misc_feature (1)..(279): Functional Homolog Of SEQ ID NO. 2
  misc_feature (48)..(70): Name: CMX-1
  misc_feature (80)..(91): Name: CMX-2
  misc_feature (137)..(186): Pfam Name: AP2 Pfam Description: AP2 domain
MTFSITAATMGANQEYMIRFDGHFEDPSPGSTIAEPPPPFGSRMFSPEQEHAAMVAALLHVISGYTTPPPELFPARAEVCLVCGMDGCLGCEFFGSGGDAADQAIALGNHNTVAHKAAATAAAAGGPQRRRRNKKNKYRGVRQRPWGKWAAEIRDPRRAVRKWLGTFDTAEEAARAYDRAAIEFRGPRAKLNFPFPEQHDVASGNGGDGSSIAAKSSDTYSPPSPSSEDLVEARVPQGWQQQQHGGEETGEQLWDGLQDLMKLDEGELSWFPRSSNSWN

SEQ ID NO: 11 - protein, 259 aa, Hordeum vulgare
  misc_feature (1)..(259): Public GI ID no. 326518784
  misc_feature (1)..(259): Hordeum vulgare subsp. vulgare
  misc_feature (1)..(259): Bit score of 325.7 for HMM based on sequences of Figure 1
  misc_feature (1)..(259): Functional Homolog Of SEQ ID NO. 2
  misc_feature (46)..(68): Name: CMX-1
  misc_feature (77)..(88): Name: CMX-2
  misc_feature (127)..(176): Pfam Name: AP2 Pfam Description: AP2 domain
MTFSLSAAMEGGHQEYMIRFDDPSPSTATAEPPPPEPFAGRAITPDQEHSAMVAALLHVISGYTTPPPDLFPTREVCPVCRVDGCLGCDFFGAAEAEATGTRQIAATLDAPKAAGGPQRRRRNKKNKYRGVRQRPWGKWAAEIRDPRRAVRVWLGTFDTAEDAARAYDRAAVEFRGPRAKLNFPFPEQQQQLGDGNAAAAKSDTCSPSPRSADAEVRVPQSWQQNGGQEAGDQLWDGLQDLMKLDESELWFPPSSNSWD

SEQ ID NO: 12 - DNA, 1139 bp, Triticum aestivum
  misc_feature (1)..(1139): Ceres Clone ID no. 634402
  misc_feature (1)..(1139): Encodes the peptide sequence at SEQ ID NO. 13
aaccatcaccaccgagctacctccagcctccagccatcactcagctcaaagacacaatcaggcaatcagcggcggcgagaacacacacagagtcacagatgaccttcagcgtctcgccggcgacgggggcgagccaggagtacatgatccggttcgacggccacttcgaggacccgagctccgcggccgcgagcgccgagccacccctgccgttcgccggcagggctttctcgccacagcaggagcagagcgccatggtcgccgcgctgctgcacgtcgtctccgggtacaccacgccggcgcctgacctcttcttcccggcgcgcaaggaggcgtgcacggcgtgcgggatggacgggtgcctcgggtgcgagttcttcggcgcggargccgggcgcgcggtcgcggcatcggacgcgccgagagcgccggcggccggcgggccgcagaggaggcggaggaacaagaagaaccagtaccgcggcgtcaggcagcggccgtggggcaagtgggcggcggagatccgcgacccgcgccgcgccgtgcgggtgtggctcgggaccttcgacacggccgaggacgccgccagggcctacgaccgcgccgccgtcgagttccgcggcccgcgcgccaagctcaacttctccttccccgagcagcagcagcagcagctaggcggcagcggcaatgccgcggccaagtcagacgcgtgctcgccctcgccttcgccccgcagcgcggacgaggacgaaacaggggacctgctctgggacggcttggtggacttgatgaagctggacgagagcgacctctgcttactgctcccggtcgacaacacggataaatttcacatagaggggaagagacgatcaggatcaggggtacccctctgctactagtgttagactattagcgagtaccagatagacaatcagcagtcctaatcctgctcactacgtggttagcacacgtcctagcttcggttgtaattctgcataaataggcacccgatcaatggaaaagttgtgttcaaccatactcatctgccatgttgtatgtagacaaatccaatttggggcttatttgttggaactataatggtttctattaatagaaaccaggggaaaccccttttgcac

SEQ ID NO: 13 - protein, 266 aa, Triticum aestivum
  misc_feature (1)..(266): Ceres Clone ID no. 634402
  misc_feature (1)..(266): Bit score of 361.2 for HMM based on sequences of Figure 1
  misc_feature (1)..(266): Functional Homolog Of SEQ ID NO. 2
  misc_feature (47)..(69): Name: CMX-1 variant
  misc_feature (80)..(91): Name: CMX-2
  misc_feature (126)..(175): Pfam Name: AP2 Pfam Description: AP2 domain
MTFSVSPATGASQEYMIRFDGHFEDPSSAAASAEPPLPFAGRAFSPQQEQSAMVAALLHVVSGYTTPAPDLFFPARKEACTACGMDGCLGCEFFGAEAGRAVAASDAPRAPAAGGPQRRRRNKKNQYRGVRQRPWGKWAAEIRDPRRAVRVWLGTFDTAEDAARAYDRAAVEFRGPRAKLNFSFPEQQQQQLGGSGNAAAKSDACSPSPSPRSADEDETGDLLWDGLVDLMKLDESDLCLLLPVDNTDKFHIEGKRRSGSGVPLCY

SEQ ID NO: 14 - DNA, 1023 bp, Zea mays
  misc_feature (1)..(1023): Ceres Clone ID no. 1494990
  misc_feature (1)..(1023): Encodes the peptide sequence at SEQ ID NO. 15
aaacaaccatcaccttcaagcttagctccagcctccagccatcactcagctcaaggcacaatcaggcactcatcggcagcaagaacacaccgaccttcagcgtctcggcgtcaatggaggcgagccggcagtacatgatccgcttcgacggccacttcgaggagggcccgagctccgcggccgccgagccaccgcagccgttcgccagcagggctttctcgccggagcaggagcagagcgtcatggtcgccgcgctgctgcacgtcgtctccgggtacgccacgccggcgccggacctcttcttcccggcgggcaaggaggcgtgcacggcgtgcggggtggacgggtgcctcggctgcgagttcttcggcgccgaggccgggcgcgcggtcgcggcatcggacgcgccgagagcggcgaccgctggcgggccgcagaggaggcggaggaacaagaagagccagtaccgcggcgtcaggcagcggccgtggggcaagtgggcggcggagatccgcgacccgcgccgcgccgtgcgggtgtggctcgggaccttcgacaccgccgaggacgccgccagggcctacgaccgcgccgccgtcaagttccgcggcccgcgcgccaagctcaacttctccttccccgagcagcatctccgcgacgacagcggcaatgccgcggccaagtcagacgcgtgctctccgtcgccttcgccccgcagcgcggaggaggaggaaacaggggacctgctctgggacggcctggtggacttgatgaagctggacgagagcgacctctgcttactgctcccggtcgacaacactttggataaatttcacgcaccgggacagagacgatcgggatcaggggtacccctctgctactagtgttagactattagcgaggacagtaccagatagactggtgtcagtgcgcttgtacgccactcctaatcctgctcactgcttggttagcacacgtcctagcttcggttgtaattctgcatgcataaataggcacccgatc

SEQ ID NO: 15 - protein, 256 aa, Zea mays
  misc_feature (1)..(256): Ceres Clone ID no. 1494990
  misc_feature (1)..(256): Bit score of 365.7 for HMM based on sequences of Figure 1
  misc_feature (1)..(256): Functional Homolog Of SEQ ID NO. 2
  misc_feature (38)..(60): Name: CMX-1
  misc_feature (71)..(82): Name: CMX-2
  misc_feature (116)..(166): Pfam Name: AP2 Pfam Description: AP2 domain
MEASRQYMIRFDGHFEEGPSSAAAEPPQPFASRAFSPEQEQSVMVAALLHVVSGYATPAPDLFFPAGKEACTACGVDGCLGCEFFGAEAGRAVAASDAPRAATAGGPQRRRRNKKSQYRGVRQRPWGKWAAEIRDPRRAVRVWLGTFDTAEDAARAYDRAAVKFRGPRAKLNFSFPEQHLRDDSGNAAAKSDACSPSPSPRSAEEEETGDLLWDGLVDLMKLDESDLCLLLPVDNTLDKFHAPGQRRSGSGVPLCY

SEQ ID NO: 16 - protein, 274 aa, Oryza sativa
  misc_feature (1)..(274): Public GI ID no. 115479555
  misc_feature (1)..(274): Oryza sativa Japonica Group
  misc_feature (1)..(274): Bit score of 262.8 for HMM based on sequences of Figure 1
  misc_feature (1)..(274): Functional Homolog Of SEQ ID NO. 2
  misc_feature (40)..(62): Name: CMX-1
  misc_feature (73)..(84): Name: CMX-2
  misc_feature (129)..(178): Pfam Name: AP2 Pfam Description: AP2 domain
MTKKVIPAMAAARQDSCKTKLDERGGSHQAPSSARWISSEQEHSIIVAALRYVVSGCTTPPPEIVTVACGEACALCGIDGCLGCDFFGAEAAGNEEAVMATDYAAAAAAAAVAGGSGGKRVRRRRKKNVYRGVRHRPWGKWAAEIRDPRRAVRKWLGTFDTAEEAARAYDRAALEFRGARAKLNFPCSEPLPMPSQRNGNGGDAVTAATTTAEQMTPTLSPCSADAEETTTPVDWQMGADEAGSNQLWDGLQDLMKLDEADTWFPPFSGAASSF

SEQ ID NO: 17 - protein, 268 aa, Arabidopsis lyrata
  misc_feature (1)..(268): Public GI ID no. 297802528
  misc_feature (1)..(268): Arabidopsis lyrata subsp. lyrata
  misc_feature (1)..(268): Bit score of 305.8 for HMM based on sequences of Figure 1
  misc_feature (1)..(268): Functional Homolog Of SEQ ID NO. 2
  misc_feature (134)..(183): Pfam Name: AP2 Pfam Description: AP2 domain
MHYPNNRTEFVGAPAPTRYQKEQLSPEQELSVIVSALQHVISGENETAPYQGFSSDSTVISAGMPRSVSDTCQVCRIEGCLGCNYFFAPNQRIEKSQQEEEITSSSNSRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVVADDIGANASASASVSATDSVEAEQWPGGEGGECNMEEWMNMMMMMDFGNGDSSDSGNTIADMFQ

SEQ ID NO: 18 - protein, 268 aa, Populus trichocarpa
  misc_feature (1)..(268): Public GI ID no. 224123482
  misc_feature (1)..(268): Bit score of 292.0 for HMM based on sequences of Figure 1
  misc_feature (1)..(268): Functional Homolog Of SEQ ID NO. 2
  misc_feature (32)..(54): Name: CMX-1
  misc_feature (96)..(107): Name: CMX-2
  misc_feature (132)..(180): Pfam Name: AP2 Pfam Description: AP2 domain
MQRPSKRSKIGEAPAATLFSPPGISPMRLTQDQESAVMVAALRNVVSGTSSTDFSREFNSLNVPITTSYSQFGSRSSNGNGFCISIWPPSSDLDMCAVCKIKGCLGCNFFPPNQEDKKDDKKGKRKRVKKNYRGVRQRPWGKWAAEIRDPRRAARVWLGTFSTAEEAARAYDKAAIDFRGPRAKLNFPFPDSGISSFEESKEKQEEQAKQQEISEKKSGFEAEMGKESEFWDKIGDDEIHEWMMMMLDFSNGDSSDSTGTESAATIGI

SEQ ID NO: 19 - DNA, 1383 bp, Arabidopsis thaliana
  misc_feature (1)..(1383): Ceres Clone ID no. 123905
  misc_feature (1)..(1383): Encodes the peptide sequence at SEQ ID NO. 20
caaaaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaatgcaagtgcaagcgccagtgtgagcgccacagattcagttgaagcagagcaatggaacggaggaggaggggattgcaatatggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaaacccaacattggtctgaattataaacgtaagtgtcaacgttgtttataaaggagaaaactataattggtgacaaaagacataaagaaaagatgtctactcctacaaagcatcgcgtgcagctattcgacaaacaatggcatctcccagagaggaaattccgagctcttggctagttatcttgtaatgctgaaaacatgaatgtatttgagtttatttctgtaacattggaagcgaaataaaagggttatcaactgttacc

SEQ ID NO: 20 - protein, 267 aa, Arabidopsis thaliana
  misc_feature (1)..(267): Ceres Clone ID no. 123905
  misc_feature (1)..(267): Bit score of 310.0 for HMM based on sequences of Figure 1
  misc_feature (1)..(267): Functional Homolog Of SEQ ID NO. 2
  misc_feature (27)..(49): Name: CMX-1
  misc_feature (72)..(83): Name: CMX-2
  misc_feature (135)..(184): Pfam Name: AP2 Pfam Description: AP2 domain
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGANASASASVSATDSVEAEQWNGGGGDCNMEWMNMMMMMDFGNGDSSDSGNTIADMFQ

SEQ ID NO: 21 - protein, 288 aa, Ricinus communis
  misc_feature (1)..(288): Public GI ID no. 255555461
  misc_feature (1)..(288): Bit score of 270.1 for HMM based on sequences of Figure 1
  misc_feature (1)..(288): Functional Homolog Of SEQ ID NO. 2
  misc_feature (40)..(69): Name: CMX-1 variant
  misc_feature (108)..(119): Name: CMX-2
  misc_feature (146)..(194): Pfam Name: AP2 Pfam Description: AP2 domain
MQRSSKRQKCTGTATPATTTDLLSPAATAVLPQQQRLTQEQEFAIMVAALGNVLSGSASSSTAMASDFSQELFHLSFPSSNSQFATSGTAAAATAINPILPPLDLDTCNVCKIRGCLGCNFFPPNQEESSNGNNKKGTRKRGKKNYRGVRQRPWGKWAAEIRDPRRATRVWLGTFNTAEDAARAYDKAAIEFRGPRAKLNFPFPDNTSNNHLEDQSHHHQQQHMQEQNVIMDGKRSEFEEAAAGQENEFLGIEAIGEDEIQQWMMMMDFNNGDSSDSAGTATTATLGF

SEQ ID NO: 22 - protein, 283 aa, Nicotiana tabacum
  misc_feature (1)..(283): Public GI ID no. 129560505
  misc_feature (1)..(283): Bit score of 347.7 for HMM based on sequences of Figure 1
  misc_feature (1)..(283): Functional Homolog Of SEQ ID NO. 2
  misc_feature (32)..(54): Name: CMX-1 variant
  misc_feature (108)..(119): Name: CMX-2
  misc_feature (155)..(203): Pfam Name: AP2 Pfam Description: AP2 domain
MQRSNKRFREDGTSNTDQNNQQFPHFPRLTGEEEYSVMVSALKNVINGSIPMENTQQFYSFSPFQYCTATSTATTVTAYSSPSNSMSTIEQGNVVSPILGVPAEQEPCPFCRIKGCLGCDIFGTTSNAAAVVAADDNKKNSTTTTAVTKKKKKNYRGVRQRPWGKWAAEIRDPRKAARVWLGTFNTAEDAARAYDKAAIEFRGPRAKLNFSFADYTEIQEQQSASSSSPQQLPEPQLQQGNNTEFGNEIWDQLMGDNEIQDWLTMMNFNGDSSDSTGGNVHSV

SEQ ID NO: 23 - DNA, 801 bp, Populus trichocarpa
  misc_feature (1)..(801): Ceres Annot ID no. 1460991
  misc_feature (1)..(801): Encodes the peptide sequence at SEQ ID NO. 24
atgcaaagatctccaaagaggcccaaaatcaatgaagctccgtcagcgactctcttttcaccgccggcagctccaccgctaagattgacccaagagcaggagttggccgtgatggttgctgctctcaaaaacgtagtttctggcaccgcttcaatggatttctcaagggagatgaatagtattaatatgccaatcatcacttcacatccacaatttggaagtgcaagcaataacgggaatggtttttgcaactctatattgcctccatcttcggatcttgacacgtgtggtgtttgcaagatcaaagggtgcttaggatgcaactttttcccgccaaatcaagaagataaaaaggacgacaagaaagggaaacgaaagagagtaaagaagaattatagaggtgtaaggcaacggccatggggaaaatgggctgcagagataagagatccacggaaagcggcaagggtttggttagggacgtttaacactgcagaggaggcggcaagggcttatgataaggcagccattgattttagagggccaagagctaagcttaattttccatttcctgatagtggtattgctagttttgaagagagtaaagaaaagcaagaaaagcagcaggaaatcagtgagaagagaagtgaatttgaaacggaaacggggaaagacaatgagttcttggataatattgtagacgaagagttacaagaatggatggcgatgattatggattttggtaatggtggttcttccaattcttccggtaccgcaagtgctgctgctaccattggtttttaa

SEQ ID NO: 24 - protein, 266 aa, Populus trichocarpa
  misc_feature (1)..(266): Ceres Annot ID no. 1460991
  misc_feature (1)..(266): Bit score of 314.2 for HMM based on sequences of Figure 1
  misc_feature (1)..(266): Functional Homolog Of SEQ ID NO. 2
  misc_feature (32)..(54): Name: CMX-1 variant
  misc_feature (96)..(107): Name: CMX-2
  misc_feature (132)..(180): Pfam Name: AP2 Pfam Description: AP2 domain
MQRSPKRPKINEAPSATLFSPPAAPPLRLTQEQELAVMVAALKNVVSGTASMDFSREMNSINMPIITSHPQFGSASNNGNGFCNSILPPSSDLDTCGVCKIKGCLGCNFFPPNQEDKKDDKKGKRKRVKKNYRGVRQRPWGKWAAEIRDPRKAARVWLGTFNTAEEAARAYDKAAIDFRGPRAKLNFPFPDSGIASFEESKEKQEKQQEISEKRSEFETETGKDNEFLDNIVDEELQEWMAMIMDFGNGGSSNSSGTASAAATIGF

SEQ ID NO: 25 - protein, 247 aa, Vitis vinifera
  misc_feature (1)..(247): Public GI ID no. 225428806
  misc_feature (1)..(247): Bit score of 302.6 for HMM based on sequences of Figure 1
  misc_feature (1)..(247): Functional Homolog Of SEQ ID NO. 2
  misc_feature (34)..(56): Name: CMX-1 variant
  misc_feature (86)..(97): Name: CMX-2
  misc_feature (120)..(168): Pfam Name: AP2 Pfam Description: AP2 domain
MQQRTPKRQKHASAPLSAGETASLQSPPQRLTPEQEGAIIVAALKTVISGGDAQDFRLFPSSMDCATTSTDVHGNAFLPISDPEPCQFCKIKGCLGCNFFQEDSKSVSVATTTKKKKKNYRGVRQRPWGKWAAEIRDPRRAARVWLGTFDTAEAAARAYDKAAIDFRGPRAKLNFPFPDNTLLTQNTVETEQPLQENQGNSEFLAQTGDINENGFWEMIGNDQWMTMVGFTGGDSSDSATTGNAHSF

SEQ ID NO: 26 - DNA, 1739 bp, Glycine max
  misc_feature (1)..(1739): Ceres Clone ID no. 625057
  misc_feature (1)..(1739): Encodes the peptide sequence at SEQ ID NO. 27
ctattcttacacggcatggatctcgtggccactctgttttagtttaatcagaagcaaaatccacaaaactaacagtgtattaaaatttctgaacctgaaaaattgttattattttgatagggtttataggaaaagcagcatacccgagttcacaaacactgaacgccgctgctccgtagtttcgatcgacgcattcttcacttcaagatatcacaatgtctataacgcacagcctcactactccactctcttcttcttcctctgctttcttagctccttcttccttcaattgcaggggacaggtttcgttgcctgtgaagagcgtgagcatttgcaaatgcgttgccacacccgaagctgagactgcctacaagacaggggtcaatcgcaatccaaatatggggaaacttcaagctggctatctctttcccgagattgctagaagaaggtctgcgcacttgctgaagtaccctgatgctaaagtaataagccttggaattggtgatacaactgaacctattcctgaagtcataactgatgcaatgtcaaagagatcacatgcattgtcgactatagaaggatacagtgggtatggagctgaacaaggtgaaaagccattaagaagggcacttgcttcaacattttacagcgatcttggcatagaagaggatgatatatttgtctcagatggagcaaagtgtgatatatctcgtctccagattgtctttgggtcaaatgtaaaaatggctgtgcaagacccttcatatccggcctatgtagactctagtgtaattatgggccagactggcctcttccagaagaatgttgagaagtttgcaaacattgaatacatgaggtgtaatccggaaaatggtttcttccctgatttgtcttcaatttctcgaccagatataatatttttctgttctccaaacaatcctactggtgctgtggcaacaagggaacaactgacccaactagttcagtttgctaaggacaatggttctatagtaatccacgattcagcttatgcaatgtatatttctggtgacaaccctcgctcaatatttgaaattcctggagccaaagaggttgccattgagacttcatcatttagcaagtatgctgggttcactggagtccgattgggttggactgtggttccgaagcagttgctgttttctgatggatttcctgttgccaaggacttcaaccgtattgtatgcacttgtttcaatggtgcttcaaatatttcccaggcaggcggtctggcttgcctttcaccagaaggtcttaaggctatgcgtgatgttattggattctacaaggaaaatactaacataataatggagacatttgattctcttgggtttaaagtctatggagggaaagatgcaccatatgtgtgggtccattttcccggccgaagctcatgggatgtattcgctgagattcttgagaagactcatgtggttacaacccctggtagtggttttggacctggtggtgaaggttttatcagggttagtgcctttggtcacagggaaaatgtcttggaggcatgcagaaggttcaagcagctatacaagtgaagttagaatatctcatttggtttcaagagttgttctcttggactgaagctagggctgtcttatttaaataatgcaattgattttccgtggagtttagattataagatgtaaagacagggtttatcaattgaggaagtatatttttct

SEQ ID NO: 27 - protein, 458 aa, Glycine max
  misc_feature (1)..(458): Ceres Clone ID no. 625057
  misc_feature (1)..(458): Bit score of 964.6 for HMM based on sequences of Figure 5
  misc_feature (1)..(458): in Figure 5
  misc_feature (89)..(453): Pfam Name: Aminotran_1_2 Pfam Description: Aminotransferase class I and II
  misc_feature (230)..(318): Pfam Name: Alliinase_C Pfam Description: Allinase
MSITHSLTTPLSSSSSAFLAPSSFNCRGQVSLPVKSVSICKCVATPEAETAYKTGVNRNPNMGKLQAGYLFPEIARRRSAHLLKYPDAKVISLGIGDTTEPIPEVITDAMSKRSHALSTIEGYSGYGAEQGEKPLRRALASTFYSDLGIEEDDIFVSDGAKCDISRLQIVFGSNVKMAVQDPSYPAYVDSSVIMGQTGLFQKNVEKFANIEYMRCNPENGFFPDLSSISRPDIIFFCSPNNPTGAVATREQLTQLVQFAKDNGSIVIHDSAYAMYISGDNPRSIFEIPGAKEVAIETSSFSKYAGFTGVRLGWTVVPKQLLFSDGFPVAKDFNRIVCTCFNGASNISQAGGLACLSPEGLKAMRDVIGFYKENTNIIMETFDSLGFKVYGGKDAPYVWVHFPGRSSWDVFAEILEKTHVVTTPGSGFGPGGEGFIRVSAFGHRENVLEACRRFKQLYK

SEQ ID NO: 28 - DNA, 1701 bp, Gossypium hirsutum
  misc_feature (1)..(1701): Ceres Clone ID no. 1925947
  misc_feature (1)..(1701): Encodes the peptide sequence at SEQ ID NO. 29
aaggcatcacatttgtggttatttggccgcataaaaaagaagcagctttttccattaatttcggagggaaaaaaaaggggaaaaaaaatctgaaaatgtctctgatgaacaatctatcaacttcaatgatttcttcatcttcatctactttcttggctccaaccagtttcaattcaagcagaacccagagtgtttcagttccattgaaaagcatcaatatagttaaatgtgttgccactcctcaagaacaacaaaatgcttacaaaactaaagtttctcgcaatgcgaacatagctaagcttcaagctggttacctgtttccagaggttgccaggagaagggctgcacacttgctcaagtacccgaatgctcaagtgataagccttggaatcggtgatactactgaacctattccagatgttattacgtctgcaatggctaagaggtctcatgcattgtctacgctggagggttacagtggttatggagctgaacaaggtgaaaaggcattgagagctgcacttgcttcaacattctatcgcaaccttggcattgaggatgatgatatttttgtctcagatggtgctaaatgtgacatatctcgccttcaggttgttttcggatctaatgtcacaatggcagtgcaagacccgtcatacccggcttacgtagattccagcgttatcatgggtcagaccggacagtttcaaaaggatgttgagaagtatggaaatatcgagtatatgaggtgtacacccgagaatggattctttcctgatttatccaaagttgctagaactgatatcatattcttctgttcaccaaacaatcctactggtgctgctgcaacacgagagcaattgactcgattggttaagtttgcaaaggacaatgggtctatcatagtctatgattctgcatatgctatgtatatgtcagacgataaccctcgttctatctttgaaattccaggagcaaaagaggttgcaattgaaacagcttcttttagtaagtatgctgggtttactggggttcgtctcggttggactgttattccaaaacagcttctgttctcagatggattccctgttgccaaagacttcaaccgtatcgtttgtacttgctttaacggtgcatctaatattgcccaagctggtggcttggcttgcctttcatccgaagggctcgaggccatgcaagaggtgatcggcttctataaagaaaacaccaaaattatagtagaaacgttcaactcgcttgggtttaaagtatatggaggaaagaatgcaccatacgtgtgggttcacttccctggccgtagctcatgggatgtgttcagcgaaatactcgagaagacccacattgttactacgcctggaagtggtttcggacctggcggtgaaggtttcatcagagtcagcgcatttggtcacagggagaatgtcttggaagcttgcagaagattcaagcagctttacaattgaatctaatagcatttgactggttacctcggtttcagacccgagacgaaaggccgtatgcttctatgatttttgttctcaattccgtaatattgcttgtaatatctcgtcagattctatgcttagaaaagactagtaatgcttcttatttatcctgtaacattcactgaaaactacctttttatttatataaataaccgcttgtattcgccaagcaaat

SEQ ID NO: 29 - protein, 462 aa, Gossypium hirsutum
  misc_feature (1)..(462): Ceres Clone ID no. 1925947
  misc_feature (1)..(462): Bit score of 981.9 for HMM based on sequences of Figure 5
  misc_feature (1)..(462): Functional Homolog Of SEQ ID NO. 27
  misc_feature (1)..(462): in Figure 5
  misc_feature (93)..(457): Pfam Name: Aminotran_1_2 Pfam Description: Aminotransferase class I and II
  misc_feature (234)..(321): Pfam Name: Alliinase_C Pfam Description: Allinase
MSLMNNLSTSMISSSSSTFLAPTSFNSSRTQSVSVPLKSINIVKCVATPQEQQNAYKTKVSRNANIAKLQAGYLFPEVARRRAAHLLKYPNAQVISLGIGDTTEPIPDVITSAMAKRSHALSTLEGYSGYGAEQGEKALRAALASTFYRNLGIEDDDIFVSDGAKCDISRLQVVFGSNVTMAVQDPSYPAYVDSSVIMGQTGQFQKDVEKYGNIEYMRCTPENGFFPDLSKVARTDIIFFCSPNNPTGAAATREQLTRLVKFAKDNGSIIVYDSAYAMYMSDDNPRSIFEIPGAKEVAIETASFSKYAGFTGVRLGWTVIPKQLLFSDGFPVAKDFNRIVCTCFNGASNIAQAGGLACLSSEGLEAMQEVIGFYKENTKIIVETFNSLGFKVYGGKNAPYVWVHFPGRSSWDVFSEILEKTHIVTTPGSGFGPGGEGFIRVSAFGHRENVLEACRRFKQLYN

SEQ ID NO: 30 - DNA, 1386 bp, Populus trichocarpa
  misc_feature (1)..(1386): Ceres Annot ID no. 1514501
  misc_feature (1)..(1386): Encodes the peptide sequence at SEQ ID NO. 31
atgtcgccgacgcaacttttatcgacttcgatttcttcttcttcctctgcttttttagccgcacctattgccttcaaagctagaaaccagaatgtttcgatcgcgtcgaaaacgccttctatttgcacgtgtgctgctgctcctcaagaacagaaaaccgtttacaaaacacaagtctcccgcaatgcaaatattgcaaagcttcaagctggttacttatttccagaggttgctcgaaggaggaatgcgcacatgctgaaataccctgatgcaaaagtgataagccttggaattggtgacactacagaacctatcccagaagttataacttctgcaatagcaaagagagcagaagcactgtctactttggagggttacagtggttatggacctgaacaaggtgaaaaacctttgagaactgcaattgcttcaacattttattcaggtcttgggatcgaggaggatgatatatttgtctctgatggtgccaaatgtgacatatctcgcctccagatggtatttggggcaaatgtaaccatggcagtgcaagatccatcatacccggcttacgttgattctagtgtcatcatgggccagactggacagtttcagaaagacgttgagaagtacggtaagattgaatacatgaggtgcactccagagaatggttttttccctgatttatccaaagtttctcgaacggatatcatatttttctgttcaccgaacaatcctactggttctgctgcaacaagggagcaactgacccaactagtacaatttgcaaaggacaatggatcaatcatcgtctatgattcagcatatgccatgtatatgtctgatgataacccacgatccatatttgaaattccgggagccaaagaggttgctttggagacatcatcttttagtaagtatgctgggtttactggagttcgtctggggtggactgttgttccaaaacagcttctatattctgatgggttcccagttgtaaaggatttcaaccgtgttgtttgcactagctttaatggggcatccaacatttgccaagctggtggtcgggcttgcctttcacctgaaggccttaaggcaatgagtgaggtgattggattctataaagaaaactccaacattataatggatacattcaattcgctcggttttaatgtatatggaggaaagaatgctccctatgtgtgggttcacttccctggccaaagctcgtgggatgttttcagtgaaattcttgagaaaactcatgtagttaccacacctgggagtggttttggacctggtggggaaggttttgtcagagtcagtgcttttggccacagggaaaatgttttagaagcctgcagaagattcaagcagctttacaattga

SEQ ID NO: 31 - protein, 461 aa, Populus trichocarpa
  misc_feature (1)..(461): Ceres Annot ID no. 1514501
  misc_feature (1)..(461): Bit score of 964.8 for HMM based on sequences of Figure 5
  misc_feature (1)..(461): Functional Homolog Of SEQ ID NO. 27
  misc_feature (1)..(461): in Figure 5
  misc_feature (92)..(456): Pfam Name: Aminotran_1_2 Pfam Description: Aminotransferase class I and II
  misc_feature (234)..(322): Pfam Name: Alliinase_C Pfam Description: Allinase
MSPTQLLSTSISSSSSAFLAAPIAFKARNQNVSIASKTPSICTCAAAPQEQKTVYKTQVSRNANIAKLQAGYLFPEVARRRNAHMLKYPDAKVISLGIGDTTEPIPEVITSAIAKRAEALSTLEGYSGYGPEQGEKPLRTAIASTFYSGLGIEEDDIFVSDGAKCDISRLQMVFGANVTMAVQDPSYPAYVDSSVIMGQTGQFQKDVEKYGKIEYMRCTPENGFFPDLSKVSRTDIIFFCSPNNPTGSAATREQLTQLVQFAKDNGSIIVYDSAYAMYMSDDNPRSIFEIPGAKEVALETSSFSKYAGFTGVRLGWTVVPKQLLYSDGFPVVKDFNRVVCTSFNGASNICQAGGRACLSPEGLKAMSEVIGFYKENSNIIMDTFNSLGFNVYGGKNAPYVWVHFPGQSSWDVFSEILEKTHVVTTPGSGFGPGGEGFVRVSAFGHRENVLEACRRFKQLYN

SEQ ID NO: 32 - DNA, 1386 bp, Arabidopsis thaliana
  misc_feature (1)..(1386): Ceres Annot ID no. 849672
  misc_feature (1)..(1386): Encodes the peptide sequence at SEQ ID NO. 33
atgtcgtcgacccatcagttagtttcttcgatgatctcttcttcctcatccactttcttagccccttcaaattttaatctcagaactcgaaatgcttgcttacccatggcaaaacgggtcaatacttgcaaatgtgttgctacgccgcaagagaagatcgagtataagaccaaagtgtcacggaattcaaacatgtccaaacttcaggctggatacctattcccggagattgcaagaagaaggtctgcacacttgttgaaatatccagatgcacaagttataagtcttggaataggcgacacaactgagccaattcctgaagtgatcacttctgctatggcaaagaaagctcatgagttgtcaacaatagagggatatagtggttatggtgctgaacaaggtgcaaagccactgagagctgctattgcgaaaacattctacggtggccttggcataggggatgatgacgtttttgtttctgatggagctaaatgtgatatctcacgtctccaggttatgtttggttccaatgttacaattgctgttcaggatccttcatatccggcttatgtggactccagtgttattatgggtcagactgggcaatttaacactgatgtgcaaaagtatggaaacatcgagtacatgagatgcactccagagaatggcttctttcccgacttgtccaccgttggcaggacagatataattttcttctgttccccaaataaccctacgggtgctgctgccacgagagagcaactaacgcagttagttgagtttgcaaagaagaacggttctataatagtgtatgattccgcctatgcaatgtacatgtctgatgataacccacgatccatcttcgaaatccctggagcagaggaggtcgctatggagacagcttcgttcagcaaatatgctggtttcactggagttcgacttggttggactgtcatcccgaaaaagctactctattcagacggtttccctgttgccaaagacttcaatcggattatctgcacttgtttcaatggtgcatctaatatctctcaagctggtgctcttgcttgccttacacccgaaggacttgaggcaatgcataaggtgattggattctataaagaaaacacaaacataatcattgacacattcacatctctcgggtatgatgtatatggaggaaagaatgcgccttacgtatgggttcacttcccgaaccaaagctcatgggatgtgtttgctgagattctggagaagactcatgtggttacaactccaggaagtgggtttggaccagggggtgaagggttcgttcgtgtcagtgcctttggtcacagagagaacatcttagaggcatgtcgaagattcaagcagctttacaaatga

SEQ ID NO: 33 - protein, 461 aa, Arabidopsis thaliana [sequence omitted]

SEQ ID NO: 34 - protein, 459 aa, Vitis vinifera
  misc_feature (1)..(459): Public GI ID no. 157355942
  misc_feature (1)..(459): Bit score of 954.3 for HMM based on sequences of Figure 5
  misc_feature (1)..(459): Functional Homolog Of SEQ ID NO. 27
  misc_feature (1)..(459): in Figure 5
  misc_feature (90)..(453): Pfam Name: Aminotran_1_2 Pfam Description: Aminotransferase class I and II
  misc_feature (234)..(320): Pfam Name: Alliinase_C Pfam Description: Allinase
MYSLMSSPSISSSSSSFLGQTHFDSRNPNACLPTKDSWICKCVATPSTETTAHTTKVSRNANMAKLQAGYLFPEIARRRSAHMLKYPDAQVISLGIGDTTEPIPEVITSGMAKKAHALSTLEGYSGYGAEQGEKQLRAAIASTFYGDLSIEESDIFVSDGAKSDISRLQVMFGSNVTMAVQDPSYPAYVDLSVILGQTGQFQKDVEKYGNIEYMKCNPENGFFPDLSTVSRTDIIFFCSPYNPTGNAATREQLTRLVQFAKDNGSILVYDSGYAMYISDDSPRSIFEIPGAKEVAIEVSSFSKYAGFTGVRLGWTVVPKELLYSDGFPVAKDFNRIECTTFNAASNISQASGLACLSPEGLEAMHKLVGFYKENTNIIMETFTSLGFSVYGGKNAPYVWVHFPGQSSWDVFSEILEKTHVVTTPGSGFGPAGDGFIRVCAFSHRGNVLEACKRFKRLYK

SEQ ID NO: 35 - protein, 464 aa, Oryza sativa
  misc_feature (1)..(464): Public GI ID no. 115452503
  misc_feature (1)..(464): Oryza sativa Japonica Group
  misc_feature (1)..(464): Bit score of 969.6 for HMM based on sequences of Figure 5
  misc_feature (1)..(464): Functional Homolog Of SEQ ID NO. 27
  misc_feature (1)..(464): in Figure 5
  misc_feature (95)..(459): Pfam Name: Aminotran_1_2 Pfam Description: Aminotransferase class I and II
  misc_feature (235)..(324): Pfam Name: Alliinase_C Pfam Description: Allinase
MAASPAAGAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 36 - DNA, 1695 bp, Panicum virgatum
  misc_feature (1)..(1695): Ceres Clone ID no. 1790933
  misc_feature (1)..(1695): Encodes the peptide sequence at SEQ ID NO. 37
acccgcactgcacactccccttaccctttcctacgccgccgcctcttctgctgacgccatggccgccgcccccgcctcttctgccgccgctatggccgcggcacccgcaatcaccgcgtcctcctcctttgtctcgtcgtcgccgtgctctctcagggtgtcgaagacaagcccccggcgacccacgggaagagtgtcccacaaaatcagctgcgtcagtagcccaccggccgccgaaacatcttacaagactagtgtcccgcgcaatgctaacatggccaagctccaagcaggatatttatttcctgagattgccaggagaagagcagctcatttgctcaagttccctgatgctaagattataagccttgggataggtgacactacggagcccattccagatgtcataacgaatgccatggcagagagagcacatgccttatcaacaattgatggctacagtggttatggagctgagcaaggtgaaaagaaactaaggtcagcaattgctgcaacctactatgtggaccttggtattgaagattcagacatatttgtctctgatggtgccaaatgtgacatttcccgcctgcaggttctttttggatctaatgtgacgattgcggtccaagacccatcataccctgcatatgttgattcaagtgttatcatgagccaaactggcttatatcagcaagatgttcagaagtacgggaacatcgagtacatgagatgcaatcctgaaaatggatttttccctgatctgtcaactgtcccacgtacagatataattttcttttgctcaccgaacaaccccactggtgctgctgcctctcgggaccaactgacgagactagtcaaatttgctaaggacaatgggtctatcattgtctatgattctgcctatgctatgtacatatcagatgatagcccaaagtctatctttgaaattcctggtgcgagagaggttgccattgagacagcatcattctcgaaatatgctgggttcactggtgtccgtctaggttggactgttgtccccaaggagcttcttttctcagatgggcatccagtcgctaaagatttcaaccgcattgtgtgcacctgcttcaatggcgcatcaaacattgctcaagctggtggcttagcttgcctctctccagagggtctgaaggctatgcatgatgttgttggcttctacaaggagaatactgaaataattgtcgacacgtttacatcgcttggattcaatgtatatggtgccaagaacgctccttatgtgtgggtgcacttccctggtcgcaattcgtgggatgtgttcgctgagatccttgagaaggcgaacgttgtcactacgcctggcagtggatttggacctggcggcgaaggctttgtgagggtcagcgcgtttggccacagagaaaacatcattgaagccgctaggagattaaaacagctgtacaagtgagcactgacgcagcttcagtaacgtcttggaaggacgatatcaataagattgcatcatgatttggaacaccaaattcgctctgtcgagctacttggagatattagaagcgaaacttgataatttcctaggcttttatgttgtggtagttctttcaaataatttccaattcgaaagatgcttgttgtatccccgagacatttgaatcaccaggtagtggttatatggcc

SEQ ID NO: 37 - protein, 469 aa, Panicum virgatum
  misc_feature (1)..(469): Ceres Clone ID no. 1790933
  misc_feature (1)..(469): Bit score of 974.2 for HMM based on sequences of Figure 5
  misc_feature (1)..(469): Functional Homolog Of SEQ ID NO. 27
  misc_feature (1)..(469): in Figure 5
  misc_feature (100)..(464): Pfam Name: Aminotran_1_2 Pfam Description: Aminotransferase class I and II
  misc_feature (239)..(329): Pfam Name: Alliinase_C Pfam Description: Allinase
MAAAPASSAAAMAAAPAITASSSFVSSSPCSLRVSKTSPRRPTGRVSHKISCVSSPPAAETSYKTSVPRNANMAKLQAGYLFPEIARRRAAHLLKFPDAKIISLGIGDTTEPIPDVITNAMAERAHALSTIDGYSGYGAEQGEKKLRSAIAATYYVDLGIEDSDIFVSDGAKCDISRLQVLFGSNVTIAVQDPSYPAYVDSSVIMSQTGLYQQDVQKYGNIEYMRCNPENGFFPDLSTVPRTDIIFFCSPNNPTGAAASRDQLTRLVKFAKDNGSIIVYDSAYAMYISDDSPKSIFEIPGAREVAIETASFSKYAGFTGVRLGWTVVPKELLFSDGHPVAKDFNRIVCTCFNGASNIAQAGGLACLSPEGLKAMHDVVGFYKENTEIIVDTFTSLGFNVYGAKNAPYVWVHFPGRNSWDVFAEILEKANVVTTPGSGFGPGGEGFVRVSAFGHRENIIEAARRLKQLYK

SEQ ID NO: 38 - DNA, 1389 bp, Sorghum bicolor
  misc_feature (1)..(1389): Ceres Annot ID no. 8641620
  misc_feature (1)..(1389): Encodes the peptide sequence at SEQ ID NO. 39
atggcagcagcccctgccggtgcccccgcaatcaccgcctcatcctcctttcttgcttcgccgccgttcgctctcaaggcatcgacgactagccaccgccgacctgcggggagagtctccgtcaacatccgctgcgtcagtagcccgccggccgtcgacacatcttacaagactaatgtcccgcgcaatgctaacatggccaagctccaagcaggatatctgtttcctgagattgccaggagaagagcagctcatttgctgaagtatccagatgccaagataataagccttgggataggtgacactaccgagcccattccaaatgtcataacaaatgccatggcagagagagcacttgccttgtcaacaattgatggctacagcggttatggagccgagcaaggtgaaaagaaactcagagcagcaattgctgcaacctactatgcggaccttggtattgaagattcagatatttttgtctctgatggtgccaagtgtgacatatctcgcttgcaggtcctttttggatctaatgtgacaattgcggtccaagatccctcataccctgcatatgttgattcaagtgttatcatgggccaaactgacttatatcagcaagatgttcagaagtacggaaacattcaatacatgagatgcagtccagaaaatggatttttccctgatctgtcaactatccctcggacagatattattttcttttgttcacccaacaatcctactggtgctgctgcatctcgggaccaactgaccaaattagtaaaatttgcaaaggacaatgggtccatcattgtctatgattctgcttatgcaatgtacatatcagatgacagcccaaagtctatctttgaaattcctggagcaaaggaggttgctcttgagacagcgtcattctcgaaatatgctgggttcactggtgtccgtctaggttggactgttgtccccaaggagctccttttctctgatggacatccagttgctaaagatttcaatcgcatagtctgcacttgcttcaatggtgcatcaaacatttcacaagctggtggtttagcttgcctctctccagagggtctgaaggctatgcatgatgttgttggcttctacaaggagaacactgaaataattgttgacacatttacatcacttggattcaacgtgtatggtgcgaagaacgctccttacgtatgggtgcacttccctggccgcaattcgtgggacgtgtttgctgagatcctggagaaggcgaatgtggttactactcctggcagtggatttggaccgggtggcgaaggctttgtgagggtcagcgcattcggacacagagataacatcattgaagctgcaaggagattaaagcagctgtacaagtga

SEQ ID NO: 39 - protein, 462 aa, Sorghum bicolor
  misc_feature (1)..(462): Ceres Annot ID no. 8641620
  misc_feature (1)..(462): Bit score of 974.8 for HMM based on sequences of Figure 5
  misc_feature (1)..(462): Functional Homolog Of SEQ ID NO. 27
  misc_feature (1)..(462): in Figure 5
  misc_feature (93)..(456): Pfam Name: Aminotran_1_2 Pfam Description: Aminotransferase class I and II
  misc_feature (233)..(322): Pfam Name: Alliinase_C Pfam Description: Allinase
MAAAPAGAPAITASSSFLASPPFALKASTTSHRRPAGRVSVNIRCVSSPPAVDTSYKTNVPRNANMAKLQAGYLFPEIARRRAAHLLKYPDAKIISLGIGDTTEPIPNVITNAMAERALALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIQYMRCSPENGFFPDLSTIPRTDIIFFCSPNNPTGAAASRDQLTKLVKFAKDNGSIIVYDSAYAMYISDDSPKSIFEIPGAKEVALETASFSKYAGFTGVRLGWTVVPKELLFSDGHPVAKDFNRIVCTCFNGASNISQAGGLACLSPEGLKAMHDVVGFYKENTEIIVDTFTSLGFNVYGAKNAPYVWVHFPGRNSWDVFAEILEKANVVTTPGSGFGPGGEGFVRVSAFGHRDNIIEAARRLKQLYK

SEQ ID NO: 40 - DNA, 1718 bp, Zea mays
  misc_feature (1)..(1718): Ceres Clone ID no. 281497
  misc_feature (1)..(1718): Encodes the peptide sequence at SEQ ID NO. 41
aaaaaaactcacatcgttccctacaccctactccctccgtcagccagcgaagttccttcagtcactcaacaccttacgtccctagccatcctccgccgcctccgtctctgcttccctagagccgtcgcgatggcagcagcccctgccggtgcccctgcaatcaccgcatcctcctcctttgtttcttcgtctccgttctgtctcaaggcatcgatgaccagccagcgccgacccgcggggagagtctccatcgtcatccgctgcgtcagtagcccgccggccgtcgacacatctttcaagactaatgtcccgcgcaatgctaatatggccaaactccaagcaggatatttgtttcctgagattgccaggagaagagccgctcatttgctgaagtttccagatgccaaaattataagccttggaataggcgacactaccgagcccattccaaatgtcataacaaatgccatggcagagagagcacatgccttgtcaacaattgatggctacagcggttatggagctgagcaaggtgaaaagaaactcagagcagcaattgctgcaacctactatgcggaccttggtattgaagattcagacatatttgtctctgatggtgccaaatgtgacatatctcgcttgcaggtcctttttggatctaatgtgacaattgcggtccaagatccatcataccctgcatatgttgattcaagtgttatcatggggcaaactgatttatatcagcaagacgttcagaagtatggaaacattgagtacatgagatgcggtccagaaaatggattttttcctgatctgtcaactgtccctaggacagatattattttcttttgttcacccaacaatcctactggtgctgctgcatctcgggaccaactaaccaaattagtaaaatttgcaaaggacaacgggtccatcatagtctatgattctgcttatgcaatgtacatatcagatgacagcccaaagtctatctttgaaattcctggagcaaaggaggttgctattgagacagcctcattctcgaaatacgctgggttcacaggtgtccgtmtaggttggactgttgtccccaaggagctccttttctcggatggacatccagttgctaaagatttcaatcgcatagtttgcacttgcttcaatggtgcatcaaacattgcgcaagctggtggtttagcctgcctctctccagacggtctaaaggctatgcaagatgttgttggcttctacaaggagaacactgaaataatsgttgagacatktacatcactcggattcaacgtgtatggcgccaagaacgctccatacgtatgggtgcacttccctggccgcaattcgtgggatgtgttcgctgagatcctggagaaggccaatgtggtcactactcctggcactggatttggaccgggtggcgaaggctttgtgagggtcagcgcgttcgggcacagagagaacatcattgaagccgcaaggaggtyaaagcagctgtataagtgagcaccgatgcagcttctgtgccctcctagacagatgtatcaataagaacacatcagggcaccaaaaatcgcttggtgaagctgccagaagatgttagattttgaacttttttttttaattctcgtgcggtgtctacattcraaccatttcgaactctagacaatgcttgttgtaatcctgagacccttcattcactggtg

SEQ ID NO: 41 - protein, 462 aa, Zea mays
  MISC_FEATURE (1)..(462): Ceres Clone ID no. 281497
  MISC_FEATURE (1)..(462): Bit score of 966.8 for HMM based on sequences of Figure 5
  MISC_FEATURE (1)..(462): Functional Homolog Of SEQ ID NO. 27
  MISC_FEATURE (1)..(462): in Figure 5
  MISC_FEATURE (93)..(455): Pfam Name: Aminotran_1_2 Pfam Description: Aminotransferase class I and II
  MISC_FEATURE (231)..(322): Pfam Name: Aminotran_1_2 Pfam Description: Aminotransferase class I and II
  misc_feature (315)..(315): Xaa can be any naturally occurring amino acid
  misc_feature (381)..(381): Xaa can be any naturally occurring amino acid
  misc_feature (385)..(385): Xaa can be any naturally occurring amino acid
  misc_feature (457)..(457): Xaa can be any naturally occurring amino acid
MAAAPAGAPAITASSSFVSSSPFCLKASMTSQRRPAGRVSIVIRCVSSPPAVDTSFKTNVPRNANMAKLQAGYLFPEIARRRAAHLLKFPDAKIISLGIGDTTEPIPNVITNAMAERAHALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIEYMRCGPENGFFPDLSTVPRTDIIFFCSPNNPTGAAASRDQLTKLVKFAKDNGSIIVYDSAYAMYISDDSPKSIFEIPGAKEVAIETASFSKYAGFTGVRXGWTVVPKELLFSDGHPVAKDFNRIVCTCFNGASNIAQAGGLACLSPDGLKAMQDVVGFYKENTEIXVETXTSLGFNVYGAKNAPYVWVHFPGRNSWDVFAEILEKANVVTTPGTGFGPGGEGFVRVSAFGHRENIIEAARRXKQLYK

SEQ ID NO: 42 - protein, 465 aa, Physcomitrella patens
  misc_feature (1)..(465): Public GI ID no. 168013851
  misc_feature (1)..(465): Physcomitrella patens subsp. patens
  misc_feature (1)..(465): Bit score of 897.3 for HMM based on sequences of Figure 5
  misc_feature (1)..(465): Functional Homolog Of SEQ ID NO. 27
  misc_feature (1)..(465): in Figure 5
  misc_feature (93)..(455): Pfam Name: Aminotran_1_2 Pfam Description: Aminotransferase class I and II
  misc_feature (183)..(321): Pfam Name: Alliinase_C Pfam Description: Allinase
MSIPSARLCTVPATRNLSSSVSFSTATSLLPKVSVTRGASVSLIRCIAEPAEKTTYTTSVNRNANIAKLQAGYLFPEIARRRNAHIQRYPDAKVISLGIGDTTEPIPTVITGAMEARARALSTLEGYSGYGAEQGEKPLRAGIGAAFYADLGIDETEIFVSDGAKCDITRLQLVFGPNVTMAAQDPSYPAYVDTSVMMGQTGLFQSDSQQYSKIQYMKCTPENDFFPDLSSTPRTDIIFFCSPNNPTGASASRKQLEELVAFAKKNGSIIVYDSAYAIYTSDDSPKSIYEIPGAKECAIETASFSKYAGFTGVRLGWTVVPKALKFADGHPVHTDFNRVMTTCFNGASNVAQAGGLACVSSEGLKAMHETVKFYKENTKILVETFESLGFKTFGGKNAPYVWVQFPGKSSWDVFSEILEQTHIVTTPGSGFGPGGEGFIRASAFGHRENILEASRRLKEYFGSKK

SEQ ID NO: 43 - DNA, 1503 bp, Arabidopsis thaliana
  misc_feature (1)..(1503): Ceres Clone ID no. 143214
  misc_feature (1)..(1503): Encodes the peptide sequence at SEQ ID NO. 44
attttgctctgcaaatttgtctgaaaaaatctttgtgcgaagcaggaaaaatgtcgtcgacccatcagttagtttcttcgatgatctcttcttcctcatccactttcttagccccttcaaattttaatctcagaactcgaaatgcttgcttacccatggcaaaacgggtcaatacttgcaaacttcaggctggatacctattcccggagattgcaagaagaaggtctgcacacttgttgaaatatccagatgcacaagttataagtcttggaataggcgacacaactgagccaattcctgaagtgatcacttctgctatggcaaagaaagctcatgagttgtcaacaatagagggatatagtggttatggtgctgaacaaagtgcaaagccactgagagctgctattgcgaaaacattctacggtggccttggcataggggatgatgacgtttttgtttctgatggagctaaatgtgatatctcacgtctccaggttatgtttggttccaatgttacaattgctgttcaggatccttcatatccggcttatgtggactccagtgttattatgggtcagactgggcaatttaacactgatgtgcaaaagtatggaaacatcgagtacatgagatgcactccagagaatggcttctttcccgacttgtccaccgttggcaggacagatataattttcttctgttccccaaataaccctacgggtgctgctgccacgagagagcaactaacgcagttagttgagtttgcaaagaagaacggttctataatagtgtatgattccgcctatgcaatgtacatgtctgatgataacccacgatccatcttcgaaatccctggagcagaggaggtcgctatggagacagcttcgttcagcaaatatgctggtttcactggagttcgacttggttggactgtcatcccgaaaaagctactctattcagacggtttccctgttgccaaagacttcaatcggattatctgcacttgtttcaatggtgcatctaatatctctcaagctggtgctcttgcttgccttacacccgaaggacttgaggcaatgcataaggtgattggattctataaagaaaacacaaacataatcattgacacattcacatctctcgggtatgatgtatatggaggaaagaatgcgccttacgtatgggttcacttcccgaaccaaagctcatgggatgtgtttgctgagattctggagaagactcatgtggttacaactccaggaagtgagtttggaccagggggtgaagggttcgttcgtgtcagtgcctttggtcacagagagaacatcttagaggcatgtcgaagattcaagcagctttacaaatgaagaaccttgtttgtaatcgttcctcatcatcatcaccctctttaatgacatgatttgagttaaaataatgtcgtttccattgttttctggaatttgtagaagacacttttgacaccagtgtttcaagcaatttggc

SEQ ID NO: 44 - protein, 438 aa, Arabidopsis thaliana
  misc_feature (1)..(438): Ceres Clone ID no. 143214
  misc_feature (1)..(438): Bit score of 887.7 for HMM based on sequences of Figure 5
  misc_feature (1)..(438): Functional Homolog Of SEQ ID NO. 27
  misc_feature (69)..(433): Pfam Name: Aminotran_1_2 Pfam Description: Aminotransferase class I and II
  misc_feature (211)..(302): Pfam Name: Alliinase_C Pfam Description: Allinase
MSSTHQLVSSMISSSSSTFLAPSNFNLRTRNACLPMAKRVNTCKLQAGYLFPEIARRRSAHLLKYPDAQVISLGIGDTTEPIPEVITSAMAKKAHELSTIEGYSGYGAEQSAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGRTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSEFGPGGEGFVRVSAFGHRENILEACRRFKQLYK

SEQ ID NO: 45 - DNA, 1678 bp, Panicum virgatum
  misc_feature (1)..(1678): Ceres Clone ID no. 1781022
  misc_feature (1)..(1678): Encodes the peptide sequence at SEQ ID NO. 46
gtcccccgtgacagcgaagcagaggctcatcaccctacccaagtacccatcctccgccgccgccatggcagcagcccccaccggcggccccgccatcaccatgtcctcctcctccttcctctctccgtcgccgttctatgtcaaggcgtcgaggaccagccaccgccgacccgccaggagaatgcctgtcaccgtccgctgcgtcagtagcccgccggccgccgatacagctcacaagactagtgtcccgcgcaatgcaaacatgaccaagctccaagcaggatatctgtttcctgagatagccaggagaagagcagctcatttgctgaagtaccctgatgctgagattataagccttgggataggtgacactaccgagcccattcctgacgtcataacaaatgccatggcagagagagcacatgccttatcaacaattgatggctacagtggttatggagctgagcaaggtgaaaagaaactaagggcagcaattgctgcaacctactatgcggaccttggtattgaagattcagacatatttgtctctgatggtgccaaatgtgacatttctcgcctccaggtcctttttggatctaatgtgacaattgcggtccaagacccatcataccctgcatatgttgattcaagtgttatcatgggccaaaccgacttatatcagcaagatgttcagaagtatgggaacattgagtacatgagatgcaatcccgaaaatggatttttccctgatctgtcaactgtcccacgaacagatataattttcttttgttcacccaacaaccctactggtgctgctgcatctcgggaccaactaacaaaactagtcaaatttgctaaggacaatgggtccatcattgtctatgattctgcttatgctatgtacatatcagatgatagtccaaagtccatctttgaaattcctggagcaaaagaggttgccattgagacagcatcattctcaaaatatgctgggttcactggtgtccgtctaggttggactgttgtccccaaggaacttcttttctcagatggacatccagttgctaaagatttcaaccgcatagtctgcacttgcttcaatggcgcatcaaacattgctcaagctggtggcttagcttgcctctctacagagggcctgaaggctatgcgtgacgtcgttggcttctacaaggagaacactgaaataattgttgacacatttacatcgcttgggttcaacgtgtatggtgccaagaacgctccttacgtgtgggtgcacttccctgatcgcaagtcgtgggatgtgttcgctgagatcctcgagaaggcaaacgttgtcactactcctggcagtggatttggaccaggcggcgaaggctttgtgagggtcagtgcattcggccacagagagaacatcattgaagccgctaggagattaaagcatatgtacaaatgagcaccgacgcaacttctgtatcgcacttgaaggactgtaccaataagatcacagctggatttggaatgccaaatcctctctttggagctaccaggagatattagaagtgatacttgataatttcgtaggctttttttttaatggtgttactccattcaaaccatttccattttgaaataatgctttgtatacctgaggcgtttaaatcaccaatggttatat

SEQ ID NO: 46 - protein, 463 aa, Panicum virgatum
  misc_feature (1)..(463): Ceres Clone ID no. 1781022
  misc_feature (1)..(463): Bit score of 967.7 for HMM based on sequences of Figure 5
  misc_feature (1)..(463): Functional Homolog Of SEQ ID NO. 27
  misc_feature (94)..(458): Pfam Name: Aminotran_1_2 Pfam Description: Aminotransferase class I and II
  misc_feature (234)..(323): Pfam Name: Alliinase_C Pfam Description: Allinase
MAAAPTGGPAITMSSSSFLSPSPFYVKASRTSHRRPARRMPVTVRCVSSPPAADTAHKTSVPRNANMTKLQAGYLFPEIARRRAAHLLKYPDAEIISLGIGDTTEPIPDVITNAMAERAHALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIEYMRCNPENGFFPDLSTVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNIAQAGGLACLSTEGLKAMRDVVGFYKENTEIIVDTFTSLGFNVYGAKNAPYVWVHFPDRKSWDVFAEILEKANVVTTPGSGFGPGGEGFVRVSAFGHRENIIEAARRLKHMYK

SEQ ID NO: 47 - DNA, 1612 bp, Triticum aestivum
  misc_feature (1)..(1612): Ceres Clone ID no. 618639
  misc_feature (1)..(1612): Encodes the peptide sequence at SEQ ID NO. 48
actgatttccccctccacctatctacccgccgccgccacgcccgccgccgacgacgatggcaactaccgcctcaccctccaccacgaccaccccccggtccttcctctcgtcgccttccttctccctcagggcatcgaagtcgagccacctccggacgacgagaaggctgcccgttaatgtacgctgcgccagtagctctccggccgccgatacatcttacacgacgaaggtctcgcggaatgccaacatagccaagctccaagcaggctatttgtttccggagattgccagaagaagggcagctcatctgctaaagcatcctgacgccaaaattataagtctgggaataggtgacactactgagcccattccggaggtcataacaaatgccatggcagagagagcacatgctttatccacagtggatggctacagtggttatggagctgaacaaggtgaaaagaaactaagggcagcaattgctgcaacctactatgcggatcttggtattgacgaaactgatatatttgtctctgatggtgccaaatgtgacatttctcgcctacaggttctttttggatctaaagtgaagattgcagttcaagatccatcatatcccgcatatgttgattcaagtgttatcatggggcaaactgacttatatcagcaggatgttcagaagtatggaaatattgaatacatgagatgcagtcctgaaaatggatttttccctgatctttccaaggtcccacggacagatatcatattcttctgttcacccaacaatcctactggtgctgctgcatctagggaccagctaacacagttggtcaaattcgcaaaggacaatgggtccataatagtctatgattctgcttatgccatgtacatatcagatgacagcccaaaatccatctttgaaattcctggggcgaaggaggttgccctcgagacagcatctttctctaaatatgctgggttcactggtgtccgactgggttggactgtggtccctaaggagctccttttctccgatgggcatccagtcgctaaagatttcaaccgcatagtctgcacttccttcaatggcgcatcgaccatctctcaggccggtggtttaggctgcctctctccagagggtctaaaggctatgcaagacgttgtcggattctacaaggagaacaccaaaatcattgtcgacacgtttgagtcgctcggattcaacgtctacggtgcgaagaatgccccctatgtgtgggtgcacttccctgaccgcaattcctgggatgtctttgccgagatccttgagaaggcaaacgtggtcactactcccggcagtggatttgggcccggcggtgagggctttgtgagggtcagtgcatttggccacagagagaacattattgaagctgcgagaagactgaagcagctatacaaatgagcgttggtttagcaggtggccccctctgtcgctggggagccaggcaataagaacccagcagcatttggagcacgaggtttgcttctcggctgctgggaagtgttagaatagagacagggtgttgtttttgctccattcgtaaccatttaatactggaaatttgcttgttc

SEQ ID NO: 48 - protein, 461 aa, Triticum aestivum
  misc_feature (1)..(461): Ceres Clone ID no. 618639
  misc_feature (1)..(461): Bit score of 946.0 for HMM based on sequences of Figure 5
  misc_feature (1)..(461): Functional Homolog Of SEQ ID NO. 27
  misc_feature (92)..(456): Pfam Name: Aminotran_1_2 Pfam Description: Aminotransferase class I and II
  misc_feature (230)..(322): Pfam Name: Alliinase_C Pfam Description: Allinase
MATTASPSTTTTPRSFLSSPSFSLRASKSSHLRTTRRLPVNVRCASSSPAADTSYTTKVSRNANIAKLQAGYLFPEIARRRAAHLLKHPDAKIISLGIGDTTEPIPEVITNAMAERAHALSTVDGYSGYGAEQGEKKLRAAIAATYYADLGIDETDIFVSDGAKCDISRLQVLFGSKVKIAVQDPSYPAYVDSSVIMGQTDLYQQDVQKYGNIEYMRCSPENGFFPDLSKVPRTDIIFFCSPNNPTGAAASRDQLTQLVKFAKDNGSIIVYDSAYAMYISDDSPKSIFEIPGAKEVALETASFSKYAGFTGVRLGWTVVPKELLFSDGHPVAKDFNRIVCTSFNGASTISQAGGLGCLSPEGLKAMQDVVGFYKENTKIIVDTFESLGFNVYGAKNAPYVWVHFPDRNSWDVFAEILEKANVVTTPGSGFGPGGEGFVRVSAFGHRENIIEAARRLKQLYK

SEQ ID NO: 49 - protein, 461 aa, Populus trichocarpa
  misc_feature (1)..(461): Public GI ID no. 118483001
  misc_feature (1)..(461): Bit score of 961.0 for HMM based on sequences of Figure 5
  misc_feature (1)..(461): Functional Homolog Of SEQ ID NO. 27
  misc_feature (92)..(456): Pfam Name: Aminotran_1_2 Pfam Description: Aminotransferase class I and II
  misc_feature (234)..(322): Pfam Name: Alliinase_C Pfam Description: Allinase
MSPTQLLSTSISSSSSAFLAAPIAFKARNQNVSIASKTPSICTCAAAPQEQKTVYKTQVSRNANIAKLQAGYLFPEVARRRNAHMLKYPDAKVISLGIGDTTEPIPEVITSAIAKRAEALSTLEGYGGYGPEQGEKPLRTAIASTFYSGLGIEEDDIFVSDGAKCDISRLQMVFGANVTMAVQDPSYPAYVDSSVIMGQTGQFQKDIEKYGKIEYMRCTPENGFFPDLSKVSRTDIIFFCSPNNPTGSAATREQLTQLVQFAKDNGSIIVYDSAYAMYMSDDNPRSIFEIPGAKEVALETSSFSKYAGFTGVRLGWTVVPKQLLYSDGFPVVKDFNRVVCTSFNGASNICQAGGRACLSPEGLKAMSEVIGFYKENSNIIMDTFNSLGFNVYGGKNAPYVWVHFPGQSSWDVFSEILEKTHVVTTPGSGFGPGGEGFVRVSAFGHRENVLEACRRFKQLYN

SEQ ID NO: 50 - DNA, 1582 bp, Arabidopsis thaliana
  misc_feature (1)..(1582): Ceres Clone ID no. 38404
  misc_feature (1)..(1582): Encodes the peptide sequence at SEQ ID NO. 51
aggttcatttgctctgcaaatttgtctgaaaaaatctttgtgcgaatcaggaaaaatgtcgtcgacccatcagttagtttcttcgatgatctcttcttcctcatccactttcttagccccttcaaattttaatctcagaactcgaaatgcttgcttacccatggcaaaacgggtcaatacttgcaaatgtgttgctacgccgcaagagaagatcgagtataagaccaaagtgtcacggaattcaaacatgtccaaacttcaggctggatacctattcccggagattgcaagaagaaggtctgcacacttgttgaaatatccagatgcacaagttataagtcttggaataggcgacacaactgagccaattcctgaagtgatcacttctgctatggcaaagaaagctcatgagttgtcaacaatagagggatatagtggttatggtgctgaacaaggtgcaaagccactgagagctgctattgcgaaaacattctacggtggccttggcataggggatgatgacgtttttgtttctgatggagctaaatgtgatatctcacgtctccaggttatgtttggttccaatgttacaattgctgttcaggatccttcatatccggcttatgtggactccagtgttattatgggtcagactgggcaatttaacactgatgtgcaaaagtatggaaacatcgagtacatgagatgcactccagagaatggcttctttcccgacttgtccaccgttggcgggacagatataattttcttctgttccccaaataaccctacgggtgctgctgccacgagagagcaactaacgcagttagttgagtttgcaaagaagaacggttctataatagtgtatgattccgcctatgcaatgtacatgtctgatgataacccacgatccatcttcgaaatccctggagcagaggaggtcgctatggagacagcttcgttcagcaaatatgctggtttcactggagttcgacttggttggactgtcatcccgaaaaagctactctattcagacggtttccctgttgccaaagacttcaatcggattatctgcacttgtttcaatggtgcatctaatatctctcaagctggtgctcttgcttgccttacacccgaaggacttgaggcaatgcataaggtgattggattctataaagaaaacacaaacataatcattgacacattcacatctctcgggtatgatgtatatggaggaaagaatgcgccttacgtatgggttcacttcccgaaccaaagctcatgggatgtgtttgctgagattctggagaagactcatgtggttacaactccaggaagtgggtttggaccagggggtgaagggttcgttcgtgtcagtgcctttggtcacagagagaacatcttagaggcatgtcgaagattcaagcagctttacaaatgaagaaccttgtttgtaatcgttcctcatcatcatcaccctctttaatgacatgatttgagttaaaataatgtcgtttccattgttttctggaatttgtagaagacacttttgacaccagtgtttcaagcaatttggcaaagc

SEQ ID NO: 51 - protein, 461 aa, Arabidopsis thaliana
  misc_feature (1)..(461): Ceres Clone ID no. 38404
  misc_feature (1)..(461): Bit score of 962.5 for HMM based on sequences of Figure 5
  misc_feature (1)..(461): Functional Homolog Of SEQ ID NO. 27
  misc_feature (92)..(456): Pfam Name: Aminotran_1_2 Pfam Description: Aminotransferase class I and II
  misc_feature (234)..(325): Pfam Name: Alliinase_C Pfam Description: Allinase
MSSTHQLVSSMISSSSSTFLAPSNFNLRTRNACLPMAKRVNTCKCVATPQEKIEYKTKVSRNSNMSKLQAGYLFPEIARRRSAHLLKYPDAQVISLGIGDTTEPIPEVITSAMAKKAHELSTIEGYSGYGAEQGAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGGTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSGFGPGGEGFVRVSAFGHRENILEACRRFKQLYK

SEQ ID NO: 52 - protein, 426 aa, Arabidopsis thaliana
  misc_feature (1)..(426): Public GI ID no. 3549670
  misc_feature (1)..(426): Bit score of 936.0 for HMM based on sequences of Figure 5
  misc_feature (1)..(426): Functional Homolog Of SEQ ID NO. 27
  misc_feature (57)..(421): Pfam Name: Aminotran_1_2 Pfam Description: Aminotransferase class I and II
  misc_feature (199)..(290): Pfam Name: Alliinase_C Pfam Description: Allinase
MAKRVNTCKCVATPQEKIEYKTKVSRNSNMSKLQAGYLFPEIARRRSAHLLKYPDAQVISLGIGDTTEPIPEVITSAMAKKAHELSTIEGYSGYGAEQGAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGRTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSGFGPGGEGFVRVSAFGHRENILEACRRFKQLYK

SEQ ID NO: 53 - protein, 464 aa, Oryza sativa
  misc_feature (1)..(464): Public GI ID no. 37703720
  misc_feature (1)..(464): Oryza sativa Indica Group
  misc_feature (1)..(464): Bit score of 969.8 for HMM based on sequences of Figure 5
  misc_feature (1)..(464): Functional Homolog Of SEQ ID NO. 27
  misc_feature (95)..(459): Pfam Name: Aminotran_1_2 Pfam Description: Aminotransferase class I and II
  misc_feature (235)..(324): Pfam Name: Alliinase_C Pfam Description: Allinase
MAASPAAAAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAERAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 54 - protein, 458 aa, Oryza sativa
  misc_feature (1)..(458): Public GI ID no. 24414269
  misc_feature (1)..(458): Bit score of 689.7 for HMM based on sequences of Figure 5
  misc_feature (1)..(458): Functional Homolog Of SEQ ID NO. 27
  misc_feature (78)..(453): Pfam Name: Aminotran_1_2 Pfam Description: Aminotransferase class I and II
  misc_feature (232)..(321): Pfam Name: Alliinase_C Pfam Description: Allinase
MATGQCMQALPMEVWNSWLLEKAVLPALDVAPPVKIGGPRRTSVLRNPNMEKLQKGYLFPEISIKREEHLKKYPDAKVISLGIGDTTEPIPSIVTSAMAEDVPFPFCRYALALSTPEGYQGYGPEQGHKNLRKEIADKVYPDMGIKESEVFISDGAQCDIARLQTLFGPNVTIAVQDPTFPGYVDNGVIMGQTGKADDGGRYAGIEYMRCAPENAFFPDLSRVRRTDVIFFCSPNNPTGHAASREQLRQLVELARRNGSIIVFDSAYSSYISSSSSSSTPRSIYEIPGAREVAIEVSSFSKFAGFTGVRLGWAVVPDELLYSDGVPVARDFDRVVCTCFNGASGIAQAGGVACLSTEEGRGAVARVVGVYRENARVLVETFRSLGKEVHGGGDAPYVWVRFPGRRSWDVFAEILEKTHVITVPGSGFGPGGEGFIRVSAFNSRDKVLEACQRLKSFLA

SEQ ID NO: 55 - protein, 439 aa, Oryza sativa
  misc_feature (1)..(439): Public GI ID no. 125603687
  misc_feature (1)..(439): Oryza sativa Japonica Group
  misc_feature (1)..(439): Bit score of 934.1 for HMM based on sequences of Figure 5
  misc_feature (1)..(439): Functional Homolog Of SEQ ID NO. 27
  misc_feature (70)..(434): Pfam Name: Aminotran_1_2 Pfam Description: Aminotransferase class I and II
  misc_feature (210)..(299): Pfam Name: Alliinase_C Pfam Description: Allinase
MAASPAAGAAAATVSSFVSPSSFSSVNFRFEAFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 56 - protein, 397 aa, Oryza sativa
  misc_feature (1)..(397): Public GI ID no. 108707679
  misc_feature (1)..(397): Oryza sativa Japonica Group
  misc_feature (1)..(397): Bit score of 911.7 for HMM based on sequences of Figure 5
  misc_feature (1)..(397): Functional Homolog Of SEQ ID NO. 27
  misc_feature (28)..(392): Pfam Name: Aminotran_1_2 Pfam Description: Aminotransferase class I and II
  misc_feature (168)..(257): Pfam Name: Alliinase_C Pfam Description: Allinase
MAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 57 - protein, 419 aa, Vitis vinifera
  misc_feature (1)..(419): Public GI ID no. 157352390
  misc_feature (1)..(419): Bit score of 735.6 for HMM based on sequences of Figure 5
  misc_feature (1)..(419): Functional Homolog Of SEQ ID NO. 27
  misc_feature (50)..(400): Pfam Name: Aminotran_1_2 Pfam Description: Aminotransferase class I and II
  misc_feature (190)..(281): Pfam Name: Alliinase_C Pfam Description: Allinase
MSATAKCMQMAGVCTRVTRNLNMEKLRNGYLFPEIAMRELEHMKKYPNAKVISLGIGDTTEPIPDIVTSSMANHARRLSTVEGYRGYGAEQGNKALRKAIAETLYGDLPIKDTEIFVSDGSQCDISRLQLLLGSNVTIAVQDPTFPAYIDSSVIIGQTGDFQDETGKYQNIKYMPCRPQNNFFPDLTTTATTDVIFICSPNNPTGHAASRKQLEQLVEFARANRSIIIFDSAYAAYVTDESPRSIFEIPGAREVAIEISSFSKFAGFTGVRLGWTVVPDELLFSNGFPVIKDYNRIVCTCFNGASSIAQAGGLACLSSDGLMVMQSVVDYYKENAKILGDTFTSLGLDVYGGINAPYAWVHFPGMKSWDVFTELLEKTHIITVPGCGFGPGGEEHIRVSAFGHRECILEASRRLKSLLS

SEQ ID NO: 58 - protein, 441 aa, Chlamydomonas reinhardtii
  misc_feature (1)..(441): Public GI ID no. 159469820
  misc_feature (1)..(441): Bit score of 711.2 for HMM based on sequences of Figure 5
  misc_feature (1)..(441): Functional Homolog Of SEQ ID NO. 27
  misc_feature (70)..(433): Pfam Name: Aminotran_1_2 Pfam Description: Aminotransferase class I and II
  misc_feature (206)..(297): Pfam Name: Alliinase_C Pfam Description: Allinase
MQLNVRSTASGARSSTRSRRMTAVVQAVAQRAGTIDVQRNENFGKLRAGYLFPEIARRRKAHQEKNPDAKIISLGIGDTTEPLPKYIADAMAKAAAGLATREGYSGYGAEQGQGALREAVASTFYGHAGRAADEIFISDGSKCDIARIQMMFGSKPTVAVQDPSYPVYVDTSVMMGMTGDHNGTGFDGIEYMVCNPDNHFFPDLSKAKRTDIIFFCSPNNPTGAAATRAQLTELVNFARKNGSILVYDAAYALYISNPDCPKTIYEIPGADEVAIETCSFSKYAGFTGVRLGWTVVPKALKYANGEPVHADWNRVMTTCFNGASNIVQAGGLACLQPEGLKEMNAMIKFYKENAQILKTTFTEMGFSVYGGDDAPYIWVGFPGKPSWDVFAEILERCNIVTTPGSGFGPAGEGFVRASAFGSRENILEAVRRFKEAYGKRN

SEQ ID NO: 59 - protein, 402 aa, Ostreococcus lucimarinus
  misc_feature (1)..(402): Public GI ID no. 145344081
  misc_feature (1)..(402): Ostreococcus lucimarinus CCE9901
  misc_feature (1)..(402): Bit score of 612.7 for HMM based on sequences of Figure 5
  misc_feature (1)..(402): Functional Homolog Of SEQ ID NO. 27
  misc_feature (28)..(396): Pfam Name: Aminotran_1_2 Pfam Description: Aminotransferase class I and II
  misc_feature (144)..(259): Pfam Name: Alliinase_C Pfam Description: Allinase
MAQLKAGYLFPEIARIRNAHLEKNPDAKIISLGIGDTTEPIPKPITDGMVAAAAALGTKEGYSAKGGYGPEAGQMELRKTIAEKLYKGTPITYEDVFASDGSKCDISRMLQMFGSGRKIAVQDPSYPAYVDSSVIMGHSTGFNDAVKQYENITYMPCGAENDFFPDLSAAKSAELIFFCSPNNPTGAAATRAQLTELVNQALESGSIIIYDAAYSAFVGNPDCPKTIYEIPGAEKCAIETCSFSKYAGFTGLRLGWTVFPEALKFSDGSSVRQDWTRMMGTSFNGASTVAQGAGLACLTDAGLAAMGDMVAFYKENAAILKRTWEEMGYKVYGGTDAPYVWVSFEGRDSWEVFTEILDKTDIVTTPGAGFGPAGNGYVRCSAFGSRENINEAARRLKESFSK

SEQ ID NO: 60 - DNA, 870 bp, Arabidopsis thaliana
  misc_feature (1)..(870): Ceres Clone ID no. 26006
  misc_feature (1)..(870): Encodes the peptide sequence at SEQ ID NO. 61
aaaaagtacgaaaggaaaatatgagtgaggagaagaggaagcaacacttcgtgctagtacatggtgcgtgccacggcgcatggtgctggtacaaggttaagcctcttctcgaggctttgggccatcgtgtaaccgccttagacctagctgcttccggtatagacacaaccaggtcaatcactgacatttctacatgtgaacaatattctgagccattgatgcagctaatgacttcattgccgaatgatgagaaggttgtactcgttggtcatagctttggaggtttgagtttagccttagccatggataagtttcccgataaaatctctgtctctgtcttcgtgactgcattcatgcccgacaccaaacactcaccatcgttcgtcgaggaaaagtttgcaagcagcatgacaccagaaggatggatgggctctgagctcgagacatatggttcagataattccggcttgtctgtgttcttcagcaccgacttcatgaagcaccgtctctaccaactttctcctgtggaggatcttgagcttggattgcttctaaagaggcctagttcattgtttattaatgaattatcgaagatggagaacttttctgagaaagggtatggatctgttcctcgagcttacattgtgtgcaaagaggacaacattatctcggaagaccatcaacgatggatgatccataattatccggcgaatttagtgattgagatggaagagacggatcatatgccaatgttttgcaaacctcaagtactaagtgaccatctattggcaatcgctgacaatttctcttaaataatattttgatgaaaatgtatttggagtggatacaataaaaatgtgttctaaatgg

SEQ ID NO: 61 - protein, 263 aa, Arabidopsis thaliana
  misc_feature (1)..(263): Ceres Clone ID no. 26006
  misc_feature (1)..(263): Bit score of 436.1 for HMM based on sequences of Figure 3
  misc_feature (1)..(263): in Figure 3
  misc_feature (10)..(252): Pfam Name: Abhydrolase_6 Pfam Description: Alpha/beta hydrolase family
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQVLSDHLLAIADNFS

SEQ ID NO: 62 - DNA, 1072 bp, Triticum aestivum
  misc_feature (1)..(1072): Ceres Clone ID no. 644331
  misc_feature (1)..(1072): Encodes the peptide sequence at SEQ ID NO. 63
atcggagccacagctacagctcaagcacagaaaaacagccacaaaaccccacccatgcacatggaggcttgtgcgggccaagctagcagcgcgcacatcgtcctggtgcacggcgcatgcctcggcggctggtcctggttcaaggtggcgacgcggctcaggtcggccgggcaccgcgtcagcacgcctgacctcgcggcgtccggcgtcgaccccaggccgctgcgcgaggtgccgacgttccgcgactacaccaagccgctgctggacctcctggagtccctcccgtccggcgagaaggtggtgctcgtcggccacagcctcggcggcgtgaacgtcgccctcgcctgcgagctgtttccggagaagatcgccgctgcggtgttcgtcgccgccttcatgccggaccacaggtcgccgccgtcgtacgtccttgaaaagttcgtggaggggagaacgctggactggatggacacggagtttaagcctcaagatcctgaggggaagctgcctacttccatgctgttcgggccgctggtcactcgtgcaaagttcttccagttgtgttcgccggaggacctcacgctgggacgatccctgatgagggtcaactccatgttcgtggacgacctgaggctgcagccgccgcacaccgaggcccgctacgggtcggtgcgcaaggcgtacgtcgtcttcaaggacgaccacgccatcgtcgagcagttccagcggtggatggtgcacaactaccccgtggacgaggtgatggaaatcgatggcgcggaccacatggcgttgctctcgacgccgaccgagctggcgcgctgcctcgctgacatcgccgtcaagtatgctgcttgacttcctcgcaaaaaataaaagaaaagtctgctgcttgacgatggtgtggcgcacgttgcttgctgatctatacatctgtctaccttatggtttgtcccgttcgttaggtttcagagacttctactgcactctatttcagaccgataatgtttcaacatcgtatcgtggtgcatgtaactttgctatttaatatttgaagataaatgttggc

SEQ ID NO: 63 - protein, 266 aa, Triticum aestivum
  misc_feature (1)..(266): Ceres Clone ID no. 644331
  misc_feature (1)..(266): Bit score of 350.7 for HMM based on sequences of Figure 3
  misc_feature (1)..(266): Functional Homolog Of SEQ ID NO. 61
  misc_feature (13)..(255): Pfam Name: Abhydrolase_6 Pfam Description: Alpha/beta hydrolase family
MEACAGQASSAHIVLVHGACLGGWSWFKVATRLRSAGHRVSTPDLAASGVDPRPLREVPTFRDYTKPLLDLLESLPSGEKVVLVGHSLGGVNVALACELFPEKIAAAVFVAAFMPDHRSPPSYVLEKFVEGRTLDWMDTEFKPQDPEGKLPTSMLFGPLVTRAKFFQLCSPEDLTLGRSLMRVNSMFVDDLRLQPPHTEARYGSVRKAYVVFKDDHAIVEQFQRWMVHNYPVDEVMEIDGADHMALLSTPTELARCLADIAVKYAA

SEQ ID NO: 64 - protein, 263 aa, Arabidopsis thaliana
  misc_feature (1)..(263): Public GI ID no. 15227859
  misc_feature (1)..(263): Bit score of 367.8 for HMM based on sequences of Figure 3
  misc_feature (1)..(263): Functional Homolog Of SEQ ID NO. 61
  misc_feature (9)..(253): Pfam Name: Abhydrolase_6 Pfam Description: Alpha/beta hydrolase family
MEKNNKKRFVLVHGLCHGAWCWYKVKTHLEAVGHCVTAVDLAASGINMTRLEEIQTLKDYCKPLLELLNSLGSDDDKVILVAHSMGGIPAALASDIFPSKIATIVFLTAFMPDTRNLPAYVYQKLIRSVPQEGWLDTVFGTYGKHECPLEFALFGPKFMAKNLYQLSPVQDLELAKMLVRVNPIITNNLAGTRSFSEEGYGTVTRIYIVCGEDMAVPEDYQWWMIKNFPPKEVMEIKCADHMAMFSKPHKLCALLVEIACKYA

SEQ ID NO: 65 - DNA, 780 bp, Populus trichocarpa
  misc_feature (1)..(780): Ceres Annot ID no. 1504349
  misc_feature (1)..(780): Encodes the peptide sequence at SEQ ID NO. 66
atgggagaggtcaacaatcaaaaaaagcattttgttttgatccatggttcagttgcaggagcttggatatggtacaaggtcaagccaaggctagaggaagctggccaccgagtcacagctcttgacatggctgcatcaggggtgaacacaaaaacaattgaagaagttcgcactttcgatctgtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgataccgtgcaccagccatcttatatgttagaaaagtttgctgaaatcggtcccagggacgaagaatggcaagacactctgttttcattccatggaacccctgaagaaccgcatacatgtgttcatatgggttgcgagtttatgaagtgcaagccctttcatctttcctccgctgagatgctcttaaatagaccaggatcgatgtttgtggaaagcctgtccaaggcaaagaagttcactgatgagagatatggatcagtgccgcgagtttatattgtttgtactgaggatttaatgatgcttgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 66 - protein, 259 aa, Populus trichocarpa
  misc_feature (1)..(259): Ceres Annot ID no. 1504349
  misc_feature (1)..(259): Bit score of 371.8 for HMM based on sequences of Figure 3
  misc_feature (1)..(259): Functional Homolog Of SEQ ID NO. 61
  misc_feature (11)..(248): Pfam Name: Abhydrolase_6 Pfam Description: Alpha/beta hydrolase family
MGEVNNQKKHFVLIHGSVAGAWIWYKVKPRLEEAGHRVTALDMAASGVNTKTIEEVRTFDLYNEPLMEFMAKLPENEKVVLVGHSLGGLNLAFAMEKFPEKVSLAVFLTAILPDTVHQPSYMLEKFAEIGPRDEEWQDTLFSFHGTPEEPHTCVHMGCEFMKCKPFHLSSAEMLLNRPGSMFVESLSKAKKFTDERYGSVPRVYIVCTEDLMMLASFQRWMIEQNGVKEVMEIPADHMPVFSTPTELCHSILELARKHA

SEQ ID NO: 67 - DNA, 867 bp, Arabidopsis thaliana
  misc_feature (1)..(867): Ceres Annot ID no. 1265088
  misc_feature (1)..(867): Encodes the peptide sequence at SEQ ID NO. 68
gaagaaaatgagtgaggaggagaggaagcaacacgtcgttctagtacatggtgcttgccatggcgcctggtgctggtacaaggttaagccgcagctcgaggcttctggccaccgcgtaaccgccgtagatctagctgcctccggtatagacatgaccaggtcaatcacagatatatccacatgcgaacaatactcagagccattgatgcagctaatgacctcactaccagatgatgagaaggttgtgcttgttggtcatagcttaggaggtttgagtttagctatggccatggatatgtttccgaccaaaatctctgtttctgtctttgtgactgctatgatgccagacaccaaacactcaccatccttcgtatgggataagctaagaaaagaaacttcacgagaggaatggttagacaccgtgtttacgagcgagaaacctgattttcctagcgagttttggatttttggaccagaattcatggccaagaacttgtatcagttgtctccagtccaagatcttgaattggcgaaaatgttggtgagggcaaacccattgattaagaaagatatggcagagagaagaagcttcagtgaggaaggatacggatccgttacacgtatatttattgtatgcggaaaggatcttgtgtcacccgaagattaccagcgatcgatgatcagcaactttcccccaaaagaagtaatggagatcaaagacgcagatcatatgccaatgttctccaagcctcaacaactatgtgctcttctcttggagattgcaaataaatatgcctaaataaatctgaaatatcatcatcactgcatatcaattacaaattcagtgtccaccacaataataagcca

SEQ ID NO: 68 - protein, 263 aa, Arabidopsis thaliana
  misc_feature (1)..(263): Ceres Annot ID no. 1265088
  misc_feature (1)..(263): Bit score of 397.0 for HMM based on sequences of Figure 3
  misc_feature (1)..(263): Functional Homolog Of SEQ ID NO. 61
  misc_feature (10)..(253): Pfam Name: Abhydrolase_6 Pfam Description: Alpha/beta hydrolase family
MSEEERKQHVVLVHGACHGAWCWYKVKPQLEASGHRVTAVDLAASGIDMTRSITDISTCEQYSEPLMQLMTSLPDDEKVVLVGHSLGGLSLAMAMDMFPTKISVSVFVTAMMPDTKHSPSFVWDKLRKETSREEWLDTVFTSEKPDFPSEFWIFGPEFMAKNLYQLSPVQDLELAKMLVRANPLIKKDMAERRSFSEEGYGSVTRIFIVCGKDLVSPEDYQRSMISNFPPKEVMEIKDADHMPMFSKPQQLCALLLEIANKYA

SEQ ID NO: 69 - protein, 250 aa, Arabidopsis thaliana
  misc_feature (1)..(250): Bit score of 378.6 for HMM based on sequences of Figure 3
  misc_feature (1)..(250): Functional Homolog Of SEQ ID NO. 61
  misc_feature (6)..(238): Pfam Name: Abhydrolase_6 Pfam Description: Alpha/beta hydrolase family
MMKQHFVLVHGSCLGAWCWYKVKPLLEASGHRVTALDLAACGIDTRSITDISTCEQYSEPLIQLMTSLPNDEKVVLVGHSYGGLTLAIAMDKFPDKISVSVFVTSFMPDTKNSPSFVLEKFASTMTPEDWMGSELEPYVVFSAEFTKHRILQLSPIEDLELRLLLKRPGSLFLNDLSRMKNFSEKGYGSVPRAYIVSKDDHTISEEYQRWMIDNYPPNLVIEMEGTDHLPLFCKPQLLSDHLLAIADKFS

SEQ ID NO: 70 - protein, 263 aa, Oryza sativa
  misc_feature (1)..(263): Public GI ID no. 125527987
  misc_feature (1)..(263): Oryza sativa Indica Group
  misc_feature (1)..(263): Bit score of 352.0 for HMM based on sequences of Figure 3
  misc_feature (1)..(263): Functional Homolog Of SEQ ID NO. 61
  misc_feature (11)..(253): Pfam Name: Abhydrolase_6 Pfam Description: Alpha/beta hydrolase family
MADGKVACKHLVLVHGACIGGWTYFKVATRLRSAGYRVTAPDLGASGVDPRPLREVPTFRDYTAPLLGLLGSLPPGEKVVLVGHSLGGINVALAAELFPDKIAAAVFLCAFMPDHTSRPSHVLEKFIEGKWLDWMDTEFKPQDAEGKLPTSMLFGPQIAQERLMQLCSPEDVTLAGSLLRMSSMFVEDLQKQQPFTEGRYGSVRKVYVVVNQDLAIPEGFQRWMIGNSPVDEVKEIDAADHLVMLSRPDELARCLADIAESYA

SEQ ID NO: 71 - protein, 267 aa, Citrus sinensis
  misc_feature (1)..(267): Public GI ID no. 14279437
  misc_feature (1)..(267): Bit score of 460.2 for HMM based on sequences of Figure 3
  misc_feature (1)..(267): Functional Homolog Of SEQ ID NO. 61
  misc_feature (1)..(267): in Figure 3
  misc_feature (12)..(256): Pfam Name: Abhydrolase_6 Pfam Description: Alpha/beta hydrolase family
MEEVVGMEEKHFVLVHGVNHGAWCWYKLKARLVAGGHRVTAVDLAASGINMKRIEDVHTFHAYSEPLMEVLASLPAEEKVILVGHSLGGVTLALAGDKFPHKISVAVFVTAFMPDTTHRPSFVLEQYSEKMGKEDDSWLDTQFSQCDASNPSHISMLFGREFLTIKIYQLCPPEDLELAKMLVRPGSMFIDNLSKESKFSDEGYGSVKRVYLVCEEDIGLPKQFQHWMIQNYPVNEVMEIKGGDHMAMLSDPQKLCDCLSQISLKYA

SEQ ID NO: 72 - protein, 262 aa, Brassica napus
  misc_feature (1)..(262): Bit score of 433.6 for HMM based on sequences of Figure 3
  misc_feature (1)..(262): Functional Homolog Of SEQ ID NO. 61
  misc_feature (10)..(252): Pfam Name: Abhydrolase_6 Pfam Description: Alpha/beta hydrolase family
MSENKRKQHFVLVHGSCHGAWCWYKVKPLLEAAGHQVTALNLAASGIDTRSITDISTCEQYSEPLLNLLKSLPDDEKVVLVGHSFGGLSLAIAMDKFPDKISVSVFLSAFMPDTKHSPSFVLEKFGSSMAHEAWMGTEFKPYGSDNSGLSMFFSFEFMKLGLYQLSPVEDLELGLLLKRPGSLFVSNLSKMKNFSDEGYGNVPRAYIVCKEDKGIPEAFQRWLIDNFPVNIVMEIDETDHMPMFCKPQQLCDHFMEIADKFV

SEQ ID NO: 73 - DNA, 953 bp, Brassica napus
  misc_feature (1)..(953): Ceres Clone ID no. 1065042
  misc_feature (1)..(953): Encodes the peptide sequence at SEQ ID NO. 74
aggaaataatatacaaaatcaaaggttaagaaaaaaaatgggtgaggagaagaatcagcagcacttcgtgctagtacatggtgcatgccacggcgcgtggtgctggaacaaggttaagccgcttctcgaggcctccggccaccgcgtaaccgccttagacctagctgcttcgggtatagacacaaccaggtctatcactgagatctccacatgcgaacaatactctgagccattgatacagctaatcgcctcattaccaagtgatgagaaggttgtgctcgttggtcatagctttggagggttcagcttagccatggccatggataagtttccagacaaaatctctgtctcagtcttcgtgactgctttcatgcccgataccaaacactcaccatcgttcgtcgtggataagtttaaacgggatacgccaccagaagcatggttgggctcggagttcaaatcatatggctcagacaattccggtgtgtcaatgtctttcagcactgagttcatgaagcacgctctctatcaactttctcctgttgaggatattgagcttggattgcttttaaagaggcccggatcattgttcatcaacgatttatccaaggtggagaacttttcggacaaagggtatggatctgttcctcgagcttacattgtgtgcaaagaggacaaaacaattacaaaagaaattcagtggtggatgatcgataattatccgacgaaagtagtgaaggagatggaggacacagatcatatgccaatgttctgcaagcctcagttactaagtgactatctcttggaaatcgcggaaaaattagcttaaattatcttgttatgaaaatgtatttggatacaaataagtgttgtcctgcaaatgggtctttctaaagatcaagacttttatcgcgttcaaatgtttgacataatttaaaataaacttaacagtc

SEQ ID NO: 74 - protein, 263 aa, Brassica napus
  misc_feature (1)..(263): Ceres Clone ID no. 1065042
  misc_feature (1)..(263): Bit score of 425.7 for HMM based on sequences of Figure 3
  misc_feature (1)..(263): Functional Homolog Of SEQ ID NO. 61
  misc_feature (10)..(251): Pfam Name: Abhydrolase_6 Pfam Description: Alpha/beta hydrolase family
MGEEKNQQHFVLVHGACHGAWCWNKVKPLLEASGHRVTALDLAASGIDTTRSITEISTCEQYSEPLIQLIASLPSDEKVVLVGHSFGGFSLAMAMDKFPDKISVSVFVTAFMPDTKHSPSFVVDKFKRDTPPEAWLGSEFKSYGSDNSGVSMSFSTEFMKHALYQLSPVEDIELGLLLKRPGSLFINDLSKVENFSDKGYGSVPRAYIVCKEDKTITKEIQWWMIDNYPTKVVKEMEDTDHMPMFCKPQLLSDYLLEIAEKLA

SEQ ID NO: 75 - protein, 265 aa, Vitis vinifera
  misc_feature (1)..(265): Public GI ID no. 157329790
  misc_feature (1)..(265): Bit score of 470.8 for HMM based on sequences of Figure 3
  misc_feature (1)..(265): Functional Homolog Of SEQ ID NO. 61
  misc_feature (11)..(255): Pfam Name: Abhydrolase_6 Pfam Description: Alpha/beta hydrolase family
MEVDRKQGRHFVLVHGACHGAWTWYKVKPRLEAAGHRVTALDMAASGINRKQIQEVHSMHEYSQPLLEMMAALPPNEKVILVGHSLGGLNLAVAMEKFPEKVSVAVFLTAFMPDTLHRPSYVLDQYVERTPNDAWLDTQFSPYGSSEKPQNSMFFGPEFISTKLYQLSPIEDLELVLALARPASLFLEDLAELKKFSNEGYGSVTSVFIRCDKDEGIRKEFQQWMIENSGGVKEVMNIKDADHMAMFSKPEELCACLLEVAHKYG

SEQ ID NO: 76 - protein, 272 aa, Arabidopsis thaliana
  misc_feature (1)..(272): Public GI ID no. 15227861
  misc_feature (1)..(272): Bit score of 379.9 for HMM based on sequences of Figure 3
  misc_feature (1)..(272): Functional Homolog Of SEQ ID NO. 61
  misc_feature (28)..(260): Pfam Name: Abhydrolase_6 Pfam Description: Alpha/beta hydrolase family
MYENGISFIISLLICGCVKSEEMMKQHFVLVHGSCLGAWCWYKVKPLLEASGHRVTALDLAACGIDTRSITDISTCEQYSEPLIQLMTSLPNDEKVVLVGHSYGGLTLAIAMDKFPDKISVSVFVTSFMPDTKNSPSFVLEKFASTMTPEDWMGSELEPYVVFSAEFTKHRILQLSPIEDLELRLLLKRPGSLFLNDLSRMKNFSEKGYGSVPRAYIVSKDDHTISEEYQRWMIDNYPPNLVIEMEGTDHLPLFCKPQLLSDHLLAIADKFS

SEQ ID NO: 77 - protein, 259 aa, Gentiana triflora
  misc_feature (1)..(259): Public GI ID no. 146272407
  misc_feature (1)..(259): Gentiana triflora var. japonica
  misc_feature (1)..(259): Bit score of 428.1 for HMM based on sequences of Figure 3
  misc_feature (1)..(259): Functional Homolog Of SEQ ID NO. 61
  misc_feature (1)..(259): in Figure 3
  misc_feature (8)..(249): Pfam Name: Abhydrolase_6 Pfam Description: Alpha/beta hydrolase family
MSPTKHFVAVHGVGHGAWVYYKLKPRIEAAGFKFTAIDLAAAGVNPKKLEEVNSLEEYCGPLFDVLAAVPEGEKVILVGHSGGGLSAAVGMEKFPKKISVAVFLNAIMPDTKNRPSYVMEEYTARTPIEAWKDTQFSAYGEPPITALLCGPEFISTSLYHLSPVEDHTLGKLLVRPGALFVEDLLKGAVKFTDEGFGSVPRVYVVATEDKTIPPEFQRWMIENNPVAEVKEIEGADHLPQFSKPDELTQVLVDIAKNHG

SEQ ID NO: 78 - DNA, 909 bp, Arabidopsis thaliana
  misc_feature (1)..(909): Ceres Clone ID no. 95094
  misc_feature (1)..(909): Encodes the peptide sequence at SEQ ID NO. 79
aactttataacgctattctcaaacaagcaaagaaccttaaccaaaaagaaaacgtctacggagacatatggagaggaaacatcacttcgtgttagttcacaacgcttatcatggagcctggatctggtacaagctcaagcccctccttgaatcagccggccaccgcgttactgctgtcgaactcgccgcctccgggatcgacccacgaccaatccaggccgttgaaaccgtcgacgaatactccaaaccgttgatcgaaaccctcaaatctcttccagagaacgaagaggtaattctggttggattcagcttcggaggcatcaacatcgctctcgccgccgacatatttccggcgaagattaaggttcttgtgttcctcaacgccttcttgcccgacacaacccacgtgccttctcacgttctggacaagtatatggagatgcctggaggtttgggagattgtgagttttcatctcatgaaacaagaaatgggacgatgagtttattgaagatgggaccaaaattcatgaaggcacgtctttaccaaaattgtcccatagaggattacgagctggcaaaaatgttgcataggcaagggtcatttttcacagaggatctatcaaagaaagaaaagtttagcgaggaaggatatggttcggtgcaacgagtttacgtaatgagtagtgaagacaaagccatcccctgcgatttcattcgttggatgattgataatttcaacgtctcgaaagtctacgagatcgatggcggagatcacatggtgatgctctccaaaccccaaaaactctttgactctctctctgctattgccaccgattatatgtaataatcttaaagtctgttttacttttttctcatcgttactaataaaacaaacccctttttccgggc

SEQ ID NO: 79 - protein, 258 aa, Arabidopsis thaliana
  misc_feature (1)..(258): Ceres Clone ID no. 95094
  misc_feature (1)..(258): Bit score of 367.4 for HMM based on sequences of Figure 3
  misc_feature (1)..(258): Functional Homolog Of SEQ ID NO. 61
  misc_feature (7)..(247): Pfam Name: Abhydrolase_6 Pfam Description: Alpha/beta hydrolase family
MERKHHFVLVHNAYHGAWIWYKLKPLLESAGHRVTAVELAASGIDPRPIQAVETVDEYSKPLIETLKSLPENEEVILVGFSFGGINIALAADIFPAKIKVLVFLNAFLPDTTHVPSHVLDKYMEMPGGLGDCEFSSHETRNGTMSLLKMGPKFMKARLYQNCPIEDYELAKMLHRQGSFFTEDLSKKEKFSEEGYGSVQRVYVMSSEDKAIPCDFIRWMIDNFNVSKVYEIDGGDHMVMLSKPQKLFDSLSAIATDYM

SEQ ID NO: 80 - DNA, 985 bp, Musa acuminata
  misc_feature (1)..(985): Ceres Clone ID no. 1714893
  misc_feature (1)..(985): Encodes the peptide sequence at SEQ ID NO. 81
acttgccatagcacctccaaatgaattatggagaaggaaggggcgacgggagctgcaacaagaagcacataattctcgtccatggcgcttgccatggagcatggtcttggcacaaggtgacgacccagttgaggtccgctgggtaccaggttacggtgcccgacctcgcggcctccggcgtcgacgagcggcggttccaggacctgcgatcgttcatccactactcccagccgctcctggacatattggcctgcctccctcctggtgagagggtcattctggtaggccacagcctcggaggcctcaacatagctttggctatggacaggttccctgagaagatcgccgccgccgtcttcgtcaccgccttgatgccggattcagtcaacccgccctcctacgtcatggacaagcttaaaaaggaaaaaaccatgttattttggagcgacacacaatttggcttggtcggggacgaagataaaggtcccgtttccctgctattcggccccaaatttttatccaagctttacacgcgtagcccacccgaggatctgacgctggcgaggaccctcatgaggccttcttccttcttccttgaagacctcgggtccatgcctcccttctccgagtcgggttacggatcggtggagaagatctacgtcgtgtgcgctcaggatgagatcctcacggaaggttttcagcgctggatgatcgagaacaacccagtgaaagaggtgagagagctggaggacgctgaccatatgcccatgttctcaaccccgaagcagctgtttcagtgcctctcggatgttgccgatgcctgtgcttgatcctcccgggttttactattacaagccaccaaatactgtggccatagtaaataagatagttgttcgtgcgttgctgctgtgatcgatgcatcatggtttgctatcagcaacggtgtatttgtttcagttatcaaatcatggacagctgagaagac

SEQ ID NO: 81 - protein, 269 aa, Musa acuminata
  misc_feature (1)..(269): Ceres Clone ID no. 1714893
  misc_feature (1)..(269): Bit score of 431.6 for HMM based on sequences of Figure 3
  misc_feature (1)..(269): Functional Homolog Of SEQ ID NO. 61
  misc_feature (1)..(269): in Figure 3
  misc_feature (17)..(257): Pfam Name: Abhydrolase_6 Pfam Description: Alpha/beta hydrolase family
MNYGEGRGDGSCNKKHIILVHGACHGAWSWHKVTTQLRSAGYQVTVPDLAASGVDERRFQDLRSFIHYSQPLLDILACLPPGERVILVGHSLGGLNIALAMDRFPEKIAAAVFVTALMPDSVNPPSYVMDKLKKEKTMLFWSDTQFGLVGDEDKGPVSLLFGPKFLSKLYTRSPPEDLTLARTLMRPSSFFLEDLGSMPPFSESGYGSVEKIYVVCAQDEILTEGFQRWMIENNPVKEVRELEDADHMPMFSTPKQLFQCLSDVADACA

SEQ ID NO: 82 - protein, 265 aa, Vitis vinifera
  misc_feature (1)..(265): Public GI ID no. 157329890
  misc_feature (1)..(265): Bit score of 471.9 for HMM based on sequences of Figure 3
  misc_feature (1)..(265): Functional Homolog Of SEQ ID NO. 61
  misc_feature (1)..(265): in Figure 3
  misc_feature (11)..(255): Pfam Name: Abhydrolase_6 Pfam Description: Alpha/beta hydrolase family
MEVDRKQGRHFVLVHGACHGAWSWYKVKPRLEAAGHRVTALDMAASGINRKQIQEVHSMHEYSQPLLEMMATLPPNEKVILVGHSLGGLNLAVAMEKFPEKVSVAVFLTAFMPDTLHRPSYVLDQYVERTPNDAWLDTQFSPYGSSEKPQNSMFFGPEFISTKLYQLSPIEDLELVLALARPASLFLEDLAELKKFSNEGYGSVTSVFIRCDKDEAIRKEFQQWMIENSGGVKEVMNIKDADHMAMFSKPEELCACLLEVAHKYG

SEQ ID NO: 83 - DNA, 913 bp, Arabidopsis thaliana
  misc_feature (1)..(913): Ceres Annot ID no. 859635
  misc_feature (1)..(913): Encodes the peptide sequence at SEQ ID NO. 84
gtgtgacttttaggagagtaagaaaatatcgaaggtcagaagaatgagtgaggaaaagaggaaacaacattttgtactagtacatggttcgtgccatggcgcgtggtgctggtacaaggttaagccgctgctagaggcggtgggccaccgcgtaactgctgtggacttagctgcctccggaatagacacaacgaggtcgatcactgacatccccacatgcgaacaatactcggagccattgacgaagctcctgacctcattgccaaatgatgaaaaggttgtgctcgttggtcacagctttggtggcttgaacttagccatagccatggaaaagtttcccgaaaaaatctctgtcgctgtattcttgactgctttcatgccggacaccgaacactcaccatccttcgtcttggacaagtttggaagcaacatgcctcaagaagcatggatgggcaccgaattcgaaccttatggttcagacaattccggactgagtatgttttttagccctgacttcatgaagttgggtctctaccagctttctccagttgaggatcttgaactgggattacttttaatgaggccaggatcgttatttattaacgatttatcgaagatgaaaaacttctcggatgaaggatatgggtctgttcctcgagttttcatagtgtgtaaagaggacaaagcaattccagaagaacgccagagatggatgattgataattttccggtgaatttagtgatggagatggaggagacagatcatatgccaatgttctgcaagcctcagcaactcagtgattacttcctgaaaatcgcggacaaattcgtttaatcaaatcttcatgaaactgtattggatttgatataataaaggtttgttgcaaatgaattaataatgatgaatattttt

SEQ ID NO: 84 - protein, 263 aa, Arabidopsis thaliana
  misc_feature (1)..(263): Ceres Annot ID no. 859635
  misc_feature (1)..(263): Bit score of 438.8 for HMM based on sequences of Figure 3
  misc_feature (1)..(263): Functional Homolog Of SEQ ID NO. 61
  misc_feature (10)..(252): Pfam Name: Abhydrolase_6 Pfam Description: Alpha/beta hydrolase family
MSEEKRKQHFVLVHGSCHGAWCWYKVKPLLEAVGHRVTAVDLAASGIDTTRSITDIPTCEQYSEPLTKLLTSLPNDEKVVLVGHSFGGLNLAIAMEKFPEKISVAVFLTAFMPDTEHSPSFVLDKFGSNMPQEAWMGTEFEPYGSDNSGLSMFFSPDFMKLGLYQLSPVEDLELGLLLMRPGSLFINDLSKMKNFSDEGYGSVPRVFIVCKEDKAIPEERQRWMIDNFPVNLVMEMEETDHMPMFCKPQQLSDYFLKIADKFV

SEQ ID NO: 85 - protein, 263 aa, Oryza sativa
  misc_feature (1)..(263): Public GI ID no. 115440397
  misc_feature (1)..(263): Oryza sativa Japonica Group
  misc_feature (1)..(263): Bit score of 352.0 for HMM based on sequences of Figure 3
  misc_feature (1)..(263): Functional Homolog Of SEQ ID NO. 61
  misc_feature (11)..(253): Pfam Name: Abhydrolase_6 Pfam Description: Alpha/beta hydrolase family
MADGKVACKHLVLVHGACIGGWTYFKVATRLRSAGYRVTAPDLGASGVDPRPLREVPTFRDYTAPLLGLLGSLPPGEKVVLVGHSLGGINVALAAELFPDKIAAAVFLCAFMPDHTSRPSHVLEKFIEGKWLDWMDTEFKPQDAEGKLPTSMLFGPQIAQERLMQLCSPEDVTLAGSLLRVSSMFVEDLQKQQPFTEGRYGSVRKVYVVVNQDLAIPEGFQRWMIGNSPVDEVKEIDAADHLVMLSRPDELARCLADIAESYA

SEQ ID NO: 86 - protein, 260 aa, Nicotiana tabacum
  misc_feature (1)..(260): Public GI ID no. 40549303
  misc_feature (1)..(260): Bit score of 465.5 for HMM based on sequences of Figure 3
  misc_feature (1)..(260): Functional Homolog Of SEQ ID NO. 61
  misc_feature (1)..(260): in Figure 3
  misc_feature (7)..(249): Pfam Name: Abhydrolase_6 Pfam Description: Alpha/beta hydrolase family
MKEGKHFVLVHGACHGGWSWYKLKPLLEAAGHKVTALDLAASGTDLRKIEELRTLYDYTLPLMELMESLSADEKVILVGHSLGGMNLGLAMEKYPQKIYAAVFLAAFMPDSVHNSSFVLEQYNERTPAENWLDTQFLPYGSPEEPLTSMFFGPKFLAHKLYQLCSPEDLALASSLVRPSSLFMEDLSKAKYFTDERFGSVKRVYIVCTEDKGIPEEFQRWQIDNIGVTEAIEIKGADHMAMLCEPQKLCASLLEIAHKYN

SEQ ID NO: 87 - DNA, 792 bp, Populus trichocarpa
  misc_feature (1)..(792): Ceres Annot ID no. 1457048
  misc_feature (1)..(792): Encodes the peptide sequence at SEQ ID NO. 88
atggtagagaccaagaatcagaagcattttgttctagtacatggagcttgccatggggcttggtgctggcaaaagttcaaaacgctgcttgagtcagcaagtaacagggtcacggtgcttgaccttgctgcttcaggcgccaacatgaaggcaatccaagatgtagaaacacttgatgaatatacggagcctttgttagagtttctggcctcattacaaccgaaggagaaggtcattctagtagggcacagcctaggaggtttgagtttggctcttgctatggaaaagttcccagagaagattgctgttgctgttttcttatcagctttcatgccagataccacacacaagccatcatttgtcttggatcagtataacgagaggaccccggcggattcctggttggacactcaatttttaccatacagcagttctcaaagtcatctcacaacaatgtcttttggacccaaattcttatcctccaagctctatcagctaagcccacctgaggatcttgagcaagcaaagactatggtaaggccaggatcactgtttctgtatgatttgtcaaaggcaaacagtttctccacgacgggctatgggtcagtcaaacgagtgtatgttatctgcgatgaagatttagcgataccagaagagtttcaacgctggatgattgaaaacagtgctgttgaagaagttatggaaattgaaggtgcagaccatatggttatgttcagcaagccacaagaactcttccattgtctctcagagatagcaaataaacatgcttaa

SEQ ID NO: 88 - protein, 263 aa, Populus trichocarpa
  misc_feature (1)..(263): Ceres Annot ID no. 1457048
  misc_feature (1)..(263): Bit score of 466.2 for HMM based on sequences of Figure 3
  misc_feature (1)..(263): Functional Homolog Of SEQ ID NO. 61
  misc_feature (1)..(263): in Figure 3
  misc_feature (10)..(251): Pfam Name: Abhydrolase_6 Pfam Description: Alpha/beta hydrolase family
MVETKNQKHFVLVHGACHGAWCWQKFKTLLESASNRVTVLDLAASGANMKAIQDVETLDEYTEPLLEFLASLQPKEKVILVGHSLGGLSLALAMEKFPEKIAVAVFLSAFMPDTTHKPSFVLDQYNERTPADSWLDTQFLPYSSSQSHLTTMSFGPKFLSSKLYQLSPPEDLEQAKTMVRPGSLFLYDLSKANSFSTTGYGSVKRVYVICDEDLAIPEEFQRWMIENSAVEEVMEIEGADHMVMFSKPQELFHCLSEIANKHA

SEQ ID NO: 89 - protein, 264 aa, Rauvolfia serpentina
  misc_feature (1)..(264): Public GI ID no. 50401192
  misc_feature (1)..(264): Bit score of 446.8 for HMM based on sequences of Figure 3
  misc_feature (1)..(264): Functional Homolog Of SEQ ID NO. 61
  misc_feature (1)..(264): in Figure 3
  misc_feature (13)..(255): Pfam Name: Abhydrolase_6 Pfam Description: Alpha/beta hydrolase family
MHSAANAKQQKHFVLVHGGCLGAWIWYKLKPLLESAGHKVTAVDLSAAGINPRRLDEIHTFRDYSEPLMEVMASIPPDEKVVLLGHSFGGMSLGLAMETYPEKISVAVFMSAMMPDPNHSLTYPFEKYNEKCPADMMLDSQFSTYGNPENPGMSMILGPQFMALKMFQNCSVEDLELAKMLTRPGSLFFQDLAKAKKFSTERYGSVKRAYIFCNEDKSFPVEFQKWFVESVGADKVKEIKEADHMGMLSQPREVCKCLLDISDS

SEQ ID NO: 90 - DNA, 795 bp, Populus trichocarpa
  misc_feature (1)..(795): Ceres Annot ID no. 1451281
  misc_feature (1)..(795): Encodes the peptide sequence at SEQ ID NO. 91
atgggagaggtcaacaatcaaaaacagcattttgttttgatccatggttcagttgcaggagcttggatatggtacaaggtcaagccaaggctagaggaagctggccaccgtgtcacagctcttgacatggctgcatcaggggtgaacacacaaaaaattgaagaagttcgcacttttgatcagtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgatacggtgcaccagccatcttatatgttagaaaagtttgctgaaatcggtcccaagggagaagagtggcaagacactctgttttcattccatggaacccctgaagaaccgcatacatgtgttcacatgggatgcgagtttatgaagtgcaagccctttcatctttcctccgctgaggatctagctctgcagatgctcttaaatagaccaggatcgatgtttgtggaaagcctgtccaaggcaaagaagttcactgatgagagatatggatcagtgccgcgagtttatattgtttgtactgaggatttaatgatgcctgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 91 - protein, 264 aa, Populus trichocarpa
  misc_feature (1)..(264): Ceres Annot ID no. 1451281
  misc_feature (1)..(264): Bit score of 392.6 for HMM based on sequences of Figure 3
  misc_feature (1)..(264): Functional Homolog Of SEQ ID NO. 61
  misc_feature (11)..(253): Pfam Name: Abhydrolase_6 Pfam Description: Alpha/beta hydrolase family
MGEVNNQKQHFVLIHGSVAGAWIWYKVKPRLEEAGHRVTALDMAASGVNTQKIEEVRTFDQYNEPLMEFMAKLPENEKVVLVGHSLGGLNLAFAMEKFPEKVSLAVFLTAILPDTVHQPSYMLEKFAEIGPKGEEWQDTLFSFHGTPEEPHTCVHMGCEFMKCKPFHLSSAEDLALQMLLNRPGSMFVESLSKAKKFTDERYGSVPRVYIVCTEDLMMPASFQRWMIEQNGVKEVMEIPADHMPVFSTPTELCHSILELARKHA

SEQ ID NO: 92 - DNA, 792 bp, Populus trichocarpa
  misc_feature (1)..(792): Ceres Annot ID no. 1510252
  misc_feature (1)..(792): Encodes the peptide sequence at SEQ ID NO. 93
atggtagagaccaagaatcaggagcattttgttctagtacatggagcttgccatggggcttggtgctggcaaaagttcaaaacgctgcttgagtcagcaagtaacagggtcacggtgcttgaccttgctgcttcaggcgccaacatgaaggcaatccaagatgtagaaacacttgatgaatatacggagcctttgttagagtttctggcctcattacaaccgaaggagaaggtcattctagtagggcacagcctaggaggtttgagtttggctcttgctatggaaaagttcccagagaagattgctgttgctgttttcttatcagctttcatgccagataccacacacaagccatcatttgtcttggatcagtataacgagaggaccccggcggattcctggttggacactcaatttttaccatacagcagttctcaaagtcatctcacaacaatgtcttttggacccaaattcttatcctccaagctctatcagctaagcccacctgaggatcttgagcaagcaaaaactttggtaaggccaggatcaatgtttctggatgatttgtcaaaggcaaacagtttctccacgacgggctatgggtcagtcaaacgagtatatgttatctttgacaaagatttagcgataccagtagagtttcaacgctggatgattgaaaacagtgctgttgaagaagttatggaaattgaaggtgcagaccatatggttatgttcagcaagccacaagaactcttccattgtctctcagagatagcaaataaacatgcttaa

SEQ ID NO: 93 - protein, 263 aa, Populus trichocarpa
  misc_feature (1)..(263): Ceres Annot ID no. 1510252
  misc_feature (1)..(263): Bit score of 457.2 for HMM based on sequences of Figure 3
  misc_feature (1)..(263): Functional Homolog Of SEQ ID NO. 61
  misc_feature (10)..(251): Pfam Name: Abhydrolase_6 Pfam Description: Alpha/beta hydrolase family
MVETKNQEHFVLVHGACHGAWCWQKFKTLLESASNRVTVLDLAASGANMKAIQDVETLDEYTEPLLEFLASLQPKEKVILVGHSLGGLSLALAMEKFPEKIAVAVFLSAFMPDTTHKPSFVLDQYNERTPADSWLDTQFLPYSSSQSHLTTMSFGPKFLSSKLYQLSPPEDLEQAKTLVRPGSMFLDDLSKANSFSTTGYGSVKRVYVIFDKDLAIPVEFQRWMIENSAVEEVMEIEGADHMVMFSKPQELFHCLSEIANKHA

SEQ ID NO: 94 - DNA, 1062 bp, Panicum virgatum
  misc_feature (1)..(1062): Ceres Clone ID no. 1822691
  misc_feature (1)..(1062): Encodes the peptide sequence at SEQ ID NO. 95
gcgccgagacgtggctgcaggcgcacgagaggtgatcgagcattcgagccgacgcgcgcgcagcaagcagcaccgtacccgagtttctcgccatgggcggcagcaagcacatcgtgctcgtccacggcgcgtgcctcggcggctggtcctggttcaaggtggccacccggctccgcgccgcggggtaccgcgtggacgcgccggacctggcggcgtcgggcgtggacccgcggccgctccgcgaggtgcccacgttccgggactacacggcgccgctgctggacctcctcgcggcgctcccggccggggaccgcgtggtgctcgtcggccacagcctcggcggcctgagcgtcgccctggccgccgagctgttcccggacaaggtcgccgccgccgtgttcctctgcgccttcatgcccgactgcgccgcgcggccgtcgcacgtgctcgagaagttcgtggaggggaagtggctggactggatggacacggagatgaagccgcaggacgcggagggcaagctccccacgtccatgatgttcgggccccggatcctgcgggagaagttctaccagctctgctcgcccgaggacatcaccctggcgtcgtccctgatgcgggtgagctcgatgttcgtggaggacctggccgcccagcagccgttcaccgcgggcgggtacggctcggtgcgcagggtgtacgtggtgtgctcggaggactacggcatcgtggaggggttccagagctggatggtggagaacaacccggtggaggaggtgagggagatcgccgccgaccacctggtgatgctctccaggcccgacgagctggcgcggtgcctcgccgacatcgccgacaagtacgcgtgatgaatgatgatgatgaggaagatcgatgctcgatagatctgccgctgcgtggatgcatggtgttctgttgtgatcagctttcttttctttcttaatcaaaaaagaaaccttggagaactcgagcctgttgtttcgaaatgagattgaagttcacggtgtggcgagcaattgaccaatcgtggatgtttattag

SEQ ID NO: 95 - protein, 258 aa, Panicum virgatum
  misc_feature (1)..(258): Ceres Clone ID no. 1822691
  misc_feature (1)..(258): Bit score of 351.5 for HMM based on sequences of Figure 3
  misc_feature (1)..(258): Functional Homolog Of SEQ ID NO. 61
  misc_feature (7)..(248): Pfam Name: Abhydrolase_6 Pfam Description: Alpha/beta hydrolase family
MGGSKHIVLVHGACLGGWSWFKVATRLRAAGYRVDAPDLAASGVDPRPLREVPTFRDYTAPLLDLLAALPAGDRVVLVGHSLGGLSVALAAELFPDKVAAAVFLCAFMPDCAARPSHVLEKFVEGKWLDWMDTEMKPQDAEGKLPTSMMFGPRILREKFYQLCSPEDITLASSLMRVSSMFVEDLAAQQPFTAGGYGSVRRVYVVCSEDYGIVEGFQSWMVENNPVEEVREIAADHLVMLSRPDELARCLADIADKYA

SEQ ID NO: 96 - protein, 259 aa, Rheum australe
  misc_feature (1)..(259): Public GI ID no. 197312921
  misc_feature (1)..(259): Bit score of 426.3 for HMM based on sequences of Figure 3
  misc_feature (1)..(259): Functional Homolog Of SEQ ID NO. 61
  misc_feature (1)..(259): in Figure 3
  misc_feature (8)..(249): Pfam Name: Abhydrolase_6 Pfam Description: Alpha/beta hydrolase family
MQSKHYMVVHGMSHGAWCWYKLKPLLESAGHRVTALDMGASGVNMRPVEELRSFRDYNAPLLSFMSSLPEDDKVVLVGHSLGGINIAFAMEEFPEKVSAAVFVAALVPDTVNKPSFFLDELFKKIGAANGWLDCQFSTFGSPDEPVTVISFGPKFLSLLYDSSPIEDYELAKMLTRPLPNYVTDLGKAEKLSDGKYGSVRRVYVICKEDKAIPDELVGQMIEWNGLKEVIELQGADHMPMLSNPQQLCDCLVQIAVENP

SEQ ID NO: 97 - DNA, 795 bp, Solanum lycopersicum
  misc_feature (1)..(795): Ceres Annot ID no. 8456439
  misc_feature (1)..(795): Encodes the peptide sequence at SEQ ID NO. 98
atggaagctaacaagaaacaaggaaaacattttgttctagtacatggtgcaggccatggagcttggtgttggtacaagctaaaaccattgctagaggctgcaggccacaaggtcactgctcttgacttagcagcctctggcattgatttgagaaaaatagagcaacttcacacacttcatgattacactttgccattattggaattaatggaatctcttccacaagaggagaaagccatattagttggacatagtcttggtggtatgaatttagcacttgctatggaaaaatacccaaaaaagatctatgctgctgttttcttggctgcttttatgcctgattctattcacatatcttcctatgttatggatcagtacaatgaacggacaccagcagagaattggttagatactcaatttttaccatatggtacccctgaagagccactcacatccatgacttttggtcccaaatttttggctgataagctttaccggttaagccctcctgaggatgttgcattaggattatcattagtgagaacaagttctctgtttctggaagatttgtcaaaggccaagtatttgacagatgaaggatatggatctgtgaagagagtttatgtagtgtgtacagaggataaaggcatatcaaaagaatttcaacaatggcaaattgataatattggtgttactgaagcaaaggaaattaaaggtgctgatcatatggcaatgctatgtatgcccaaaaaactttgtgacactctcgtggagattgcagataaatacaattga

SEQ ID NO: 98 - protein, 264 aa, Solanum lycopersicum
  misc_feature (1)..(264): Ceres Annot ID no. 8456439
  misc_feature (1)..(264): Bit score of 465.6 for HMM based on sequences of Figure 3
  misc_feature (1)..(264): Functional Homolog Of SEQ ID NO. 61
  misc_feature (1)..(264): in Figure 3
  misc_feature (11)..(254): Pfam Name: Abhydrolase_6 Pfam Description: Alpha/beta hydrolase family
MEANKKQGKHFVLVHGAGHGAWCWYKLKPLLEAAGHKVTALDLAASGIDLRKIEQLHTLHDYTLPLLELMESLPQEEKAILVGHSLGGMNLALAMEKYPKKIYAAVFLAAFMPDSIHISSYVMDQYNERTPAENWLDTQFLPYGTPEEPLTSMTFGPKFLADKLYRLSPPEDVALGLSLVRTSSLFLEDLSKAKYLTDEGYGSVKRVYVVCTEDKGISKEFQQWQIDNIGVTEAKEIKGADHMAMLCMPKKLCDTLVEIADKYN

SEQ ID NO: 99 - protein, 260 aa, Brassica rapa
  misc_feature (1)..(260): Bit score of 421.3 for HMM based on sequences of Figure 3
  misc_feature (1)..(260): Functional Homolog Of SEQ ID NO. 61
  misc_feature (10)..(251): Pfam Name: Abhydrolase_6 Pfam Description: Alpha/beta hydrolase family
MGEEKKQQHFVLVHGACHGAWCWYKVKPLLEASGHRVTALDLAASGIDTTRSITEISTCEQYSEPLIQLIASLPSDEKVVLVGHSFGGFSLTMAMDKFPDKISVSVFVTAFMPDTKHSPSFVVDKFKRETPPEAWLGSELKPYGSDNSGVSMSFSTEFMKHALYQLSPVEDIELGLLLKRPGSLFINDLSKVENFSDKGYGSVPRAYIVCKEDKTLTKEIQWWMIDNFPTKLVKEMEDTDHMPMFCKPQLLSDYLSEIAE

SEQ ID NO: 100 - protein, 258 aa, Arabidopsis thaliana
  misc_feature (1)..(258): Public GI ID no. 15028131
  misc_feature (1)..(258): Bit score of 365.9 for HMM based on sequences of Figure 3
  misc_feature (1)..(258): Functional Homolog Of SEQ ID NO. 61
  misc_feature (7)..(247): Pfam Name: Abhydrolase_6 Pfam Description: Alpha/beta hydrolase family
MERKHHFVLVHNAYHGAWIWYKLKPLLESAGHRVTAVELAASGIDPRPIQAVETVDEYSKPLIETLKSLPENEEVILVGFSFGGINIALAADIFPAKIKVLVFLNAFLPDTTHVPSHVLDKYMEMPGGLGDCEFSSHETRNGTMSLLKMGPKFMKARLYQNCPIEDYELAKMLHRQRSFFTEDLSKKEKFSEEGYGSVQRVYVMSSEDKAIPCDFIRWMIDNFNVSKVYEIDGGDHMVMLSKPQKLFDSLSAIATDYM

SEQ ID NO: 101 - DNA, 875 bp, Arabidopsis thaliana
  misc_feature (1)..(875): Ceres Clone ID no. 270875
  misc_feature (1)..(875): Encodes the peptide sequence at SEQ ID NO. 102
acatcacataccaaaaaaaggcaaaacactcacgaaagaagaaacggagaggatgaagcattatgtgctagttcacggaggctgccacggtgcgtggtgttggtacaaggtgaagccgatgcttgaacattccggccaccgtgtcacggtttttgatcttacggcgcatggtgtgaacatgagcagagtagaagatattcagactttggaggatttcgctaagccgttgcttgaggttcttgagtcttttggctcggatgataaagtagtcctcgtcgcgcatagcctcggtggaataccggctgctcttgcagccgacatgtttcctagtaaaatctctgttgctgtcttcgttacttcttttatgcccgacacaacgaatccaccttcttacgtgttcgaaaagtttctcggaagcattacagaagaagaacgtatggacttcgagttagggagctatggaacagatgaccatccactaaagactgcttttcttggacctaactacttgaagaatatgtatctactttctcctatcgaagattatgaattggccaaaatgttgatgagagtcacaccggctattactagtaatctgacggggactaaaagcttaacggcacaaggatatggatcgattagtcgtgtgtatatcgtatgcggagaagataaaggtatacgtgtagatttccaacgatggatgattgagaactctccggttaaagaagtgatggagatcaaagatgcagatcatatgcctatgttttccaagcctcatgaactctgtgatcgtcttctaaagattgctgataaatatccctaagcaagaatatctatgacaatatcaataattttcatgggaataagtttttttg

SEQ ID NO: 102 - protein, 256 aa, Arabidopsis thaliana
  misc_feature (1)..(256): Ceres Clone ID no. 270875
  misc_feature (1)..(256): Bit score of 366.8 for HMM based on sequences of Figure 3
  misc_feature (1)..(256): Functional Homolog Of SEQ ID NO. 61
  misc_feature (5)..(246): Pfam Name: Abhydrolase_6 Pfam Description: Alpha/beta hydrolase family
MKHYVLVHGGCHGAWCWYKVKPMLEHSGHRVTVFDLTAHGVNMSRVEDIQTLEDFAKPLLEVLESFGSDDKVVLVAHSLGGIPAALAADMFPSKISVAVFVTSFMPDTTNPPSYVFEKFLGSITEEERMDFELGSYGTDDHPLKTAFLGPNYLKNMYLLSPIEDYELAKMLMRVTPAITSNLTGTKSLTAQGYGSISRVYIVCGEDKGIRVDFQRWMIENSPVKEVMEIKDADHMPMFSKPHELCDRLLKIADKYP

SEQ ID NO: 103 - protein, 263 aa, Arabidopsis thaliana
  misc_feature (1)..(263): Public GI ID no. 27754457
  misc_feature (1)..(263): Bit score of 438.3 for HMM based on sequences of Figure 3
  misc_feature (1)..(263): Functional Homolog Of SEQ ID NO. 61
  misc_feature (10)..(252): Pfam Name: Abhydrolase_6 Pfam Description: Alpha/beta hydrolase family
MSEEKRKQHFVLVHGSCHGAWCWYKVKPLLEAVGHRVTAVDLAASGIDTTRSITDIPTCEQYSEPLTKLLTSLPNDEKVVLVGHSFGGLNLAIAMEKFPKKISVAVFLTAFMPDTEHSPSFVLDKFGSNMPQEAWMGTEFEPYGSDNSGLSMFFSPDFMKLGLYQLSPVEDLELGLLLMRPGSLFINDLSKMKNFSDEGYGSVPRVFIVCKEDKAIPEERQRWMIDNFPVNLVMEMEETDHMPMFCKPQQLSDYFLKIADKFV

SEQ ID NO: 104 - protein, 258 aa, Arabidopsis thaliana
  misc_feature (1)..(258): Public GI ID no. 16648679
  misc_feature (1)..(258): Bit score of 361.9 for HMM based on sequences of Figure 3
  misc_feature (1)..(258): Functional Homolog Of SEQ ID NO. 61
  misc_feature (7)..(247): Pfam Name: Abhydrolase_6 Pfam Description: Alpha/beta hydrolase family
MERKHHFVLVHNAYHGAWIWYKLKPLLESAGHRVTAVELAASGIDPRPIQAVETVDEYSKPLIETLKSLQENEEGILVGFSFGGINIALAADIFPAKIKVLVFLNAFLPDTTHVPSHVLDKYMEMPGGLGDCEFSSHETRNGTMSLLKMGPKFMKARLYQNCPIEDYELAKMLHRQGSFFTEDLSKKEKFSEEGYGSVQRVYVMSSEDKAIPCDFIRWMIDNFNVSKVYEIDGGDHMVMLSKPQKLFDSLSAIATDYM

SEQ ID NO: 105 - protein, 263 aa, Arabidopsis thaliana
  misc_feature (1)..(263): Public GI ID no. 15227863
  misc_feature (1)..(263): Bit score of 434.8 for HMM based on sequences of Figure 3
  misc_feature (1)..(263): Functional Homolog Of SEQ ID NO. 61
  misc_feature (10)..(252): Pfam Name: Abhydrolase_6 Pfam Description: Alpha/beta hydrolase family
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQLLSDHLLAIADNFC

SEQ ID NO: 106 - DNA, 795 bp, Populus trichocarpa
  misc_feature (1)..(795): Ceres Annot ID no. 1451282
  misc_feature (1)..(795): Encodes the peptide sequence at SEQ ID NO. 107
atgggagaggtcaacaatcaaaaaaagcattttgttttgatccatggttcagttgcaggagcttggatatggtacaaggtcaagccaaggctagaggaagctggccaccgagtcacagctcttgacatggctgcatcaggggtgaacacaaaaacaattgaagaagttcgcactttcgatctgtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgataccgtgcaccagccatcttatatgttagaaaagtttgctgaaatcggtcccagggacgaagaatggcaagacactctgttttcattccatggaacccctgaagaaccgcatacatgtgttcatatgggttgcgagtttatgaagtgcaagccctttcatctttcctccgctgaggatctcgctctgcagatgctcttaaatagaccaggatcgatgtttgtggaaagcctgtccaaggcaaagaagttcactgatgagagatatggatcagtgccgcgagtttatattgtttgtactgaggatttaatgatgcttgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 107 - protein, 264 aa, Populus trichocarpa
  misc_feature (1)..(264): Ceres Annot ID no. 1451282
  misc_feature (1)..(264): Bit score of 389.4 for HMM based on sequences of Figure 3
  misc_feature (1)..(264): Functional Homolog Of SEQ ID NO. 61
  misc_feature (11)..(253): Pfam Name: Abhydrolase_6 Pfam Description: Alpha/beta hydrolase family
MGEVNNQKKHFVLIHGSVAGAWIWYKVKPRLEEAGHRVTALDMAASGVNTKTIEEVRTFDLYNEPLMEFMAKLPENEKVVLVGHSLGGLNLAFAMEKFPEKVSLAVFLTAILPDTVHQPSYMLEKFAEIGPRDEEWQDTLFSFHGTPEEPHTCVHMGCEFMKCKPFHLSSAEDLALQMLLNRPGSMFVESLSKAKKFTDERYGSVPRVYIVCTEDLMMLASFQRWMIEQNGVKEVMEIPADHMPVFSTPTELCHSILELARKHA

SEQ ID NO: 108 - protein, 258 aa, Catharanthus roseus
  misc_feature (1)..(258): Public GI ID no. 53830670
  misc_feature (1)..(258): Bit score of 449.3 for HMM based on sequences of Figure 3
  misc_feature (1)..(258): Functional Homolog Of SEQ ID NO. 61
  misc_feature (1)..(258): in Figure 3
  misc_feature (8)..(247): Pfam Name: Abhydrolase_6 Pfam Description: Alpha/beta hydrolase family
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 109 - protein, 259 aa, Gentiana triflora
  misc_feature (1)..(259): Public GI ID no. 146272405
  misc_feature (1)..(259): Gentiana triflora var. japonica
  misc_feature (1)..(259): Bit score of 426.9 for HMM based on sequences of Figure 3
  misc_feature (1)..(259): Functional Homolog Of SEQ ID NO. 61
  misc_feature (8)..(249): Pfam Name: Abhydrolase_6 Pfam Description: Alpha/beta hydrolase family
MSPTKHFVAVHGVGHGAWVYYKLKPRIEAAGLKFTAIDLAAAGVNPKKLEEVNSLEEYCAPLFDVLAAVPEGEKVILVGHSGGGLSAAVGMEKFPKKISVAVFLNAIMPDTKNRPSYVMEEYTARTPIEAWKDTQFSAYGEPPITALLCGPEFISTSLYHLSPVEDHTLGKLLVRPGALFVEDLLKGAVKFTDEGFGSVPRVYVVATEDKTIPPEFQRWMIENNPVAEVKEIQGADHLPQFSKPDELTQVLVDIAKNHG

SEQ ID NO: 110 - DNA, 1888 bp, Zea mays
  misc_feature (1)..(1888): Ceres Clone ID no. 375578
  misc_feature (1)..(1888): Encodes the peptide sequence at SEQ ID NO. 111
cccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaagaacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 111 - protein, 498 aa, Zea mays
  misc_feature (1)..(498): Ceres Clone ID no. 375578
  misc_feature (1)..(498): Bit score of 847.3 for HMM based on sequences of Figure 4
  misc_feature (1)..(498): in Figure 4
  misc_feature (139)..(157): Pfam Name: IQ Pfam Description: IQ calmodulin-binding motif
  misc_feature (371)..(479): Pfam Name: DUF4005 Pfam Description: Protein of unknown function (DUF4005)
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 112 - DNA, 1497 bp, Sorghum bicolor
  misc_feature (1)..(1497): Ceres Annot ID no. 8669409
  misc_feature (1)..(1497): Encodes the peptide sequence at SEQ ID NO. 113
atgggtaagaaaggaaagtggtttagtgcggtgaagaaagtcttcagctcctctggtacagatggaaaggaagcaaaggctgagaaagcagacaagtcaaaatccaagaggagatggccattcggaaaaacgaagaagcactccgagccttcgatctcaacggtggcagggactgctccggtagctccgttgccatcaccaccaccaactcagccccactctctggagattaaagatgtcaatccacttgaaacagacagtgagcagaacaagcatgcctactctgttgcgcttgcatctgctgtcgctgctgaagctgcagcggttgctgcccaggctgctgcggaggttgtccgcctcacagcagttaccacggctgcaccaaaaatgcctgttagttcaatggaagaacttgctgccaccaagattcagactgccttcaggggttatctggcaaggagagcattgcgggcactaagagggctagttagattgaagtcgcttgttgatggaaatgctgtcaaacgccaaaccgctcacaccttgcaatgcacacaaacaatgacaagagttcaaactcaaatctattctagaagggtgaagttggaggaggagaaacaggctcttcaaaggcagctccaattgaaacatcaaagagaacttgagaaaatgaagattgatgaagactgggatcacagccatcaatccaaagagcaaattgaggccaaccttatgatgaaacaggaagctgcaatgagacgagaaagagcccttgcatatgcattttctcaccagtggaggacttctggtcgaactataacccctacttttacggaacctgggaaccctaactggggctggagctggatggaacgctggatgaccgctagaccttgggagagccgattggtggcatcagacaaggatcctaaagaacgtgctctgacaaagaatccaagcaccattactgttcaagccgcatctgtaccccgtgccatctcaatccagagaccagctacaccaaacaagtcaagccggccaccaagccggcagtcaccttcaactccaccatcgaaggccccatcaacctcaggaaagaccaggccagcaagtccaaggggcaattggctgtacaaggaggatgacctgaggagcatcacaagcatccgctctgagcgcccaaggaggcagagcacaggtggaggaggctcagtccgggatgatgcaagcctgacgagcacaccacctctccccagttacatgcaatcgacagagtctgcaagggcgaagtctcgataccgcagtctactgactgagaagcttgaggttcctgagagagcacctttggtccactctgttgttaagaagcgcctgtcgttccctgtcgtcgataagccaagtgttgtgccgacagataagccaaaggaaagagtgagacgccattcagatcctccgaaggtcgatcctgcaacactgaaggatgtccctgctgcttga

SEQ ID NO: 113 - protein, 498 aa, Sorghum bicolor
  misc_feature (1)..(498): Ceres Annot ID no. 8669409
  misc_feature (1)..(498): Bit score of 852.7 for HMM based on sequences of Figure 4
  misc_feature (1)..(498): Functional Homolog Of SEQ ID NO. 111
  misc_feature (1)..(498): in Figure 4
  misc_feature (139)..(157): Pfam Name: IQ Pfam Description: IQ calmodulin-binding motif
  misc_feature (371)..(476): Pfam Name: DUF4005 Pfam Description: Protein of unknown function (DUF4005)
MGKKGKWFSAVKKVFSSSGTDGKEAKAEKADKSKSKRRWPFGKTKKHSEPSISTVAGTAPVAPLPSPPPTQPHSLEIKDVNPLETDSEQNKHAYSVALASAVAAEAAAVAAQAAAEVVRLTAVTTAAPKMPVSSMEELAATKIQTAFRGYLARRALRALRGLVRLKSLVDGNAVKRQTAHTLQCTQTMTRVQTQIYSRRVKLEEEKQALQRQLQLKHQRELEKMKIDEDWDHSHQSKEQIEANLMMKQEAAMRRERALAYAFSHQWRTSGRTITPTFTEPGNPNWGWSWMERWMTARPWESRLVASDKDPKERALTKNPSTITVQAASVPRAISIQRPATPNKSSRPPSRQSPSTPPSKAPSTSGKTRPASPRGNWLYKEDDLRSITSIRSERPRRQSTGGGGSVRDDASLTSTPPLPSYMQSTESARAKSRYRSLLTEKLEVPERAPLVHSVVKKRLSFPVVDKPSVVPTDKPKERVRRHSDPPKVDPATLKDVPAA

SEQ ID NO: 114 - DNA, 2185 bp, Panicum virgatum
  misc_feature (1)..(2185): Ceres Clone ID no. 2034697
  misc_feature (1)..(2185): Encodes the peptide sequence at SEQ ID NO. 115
gggctcagggctttcggtggctgcctgcttgcttgcttgcttgctttagaggtggaagcttgcccttctcgcggtaaaatcggatcttttggggttttgcgcgccgctatttgattcttcttggctggcttcgcctgtggctttgttttgggggtttgctgggttggtttcttcgcgattgtggacgagggggtgcggtgggcagctgcgagagtttctctgggtctggggcaaatacactcttccggtctccctgtcgtttgcgattcgaccttctggtgagtttttgcgccagctaaacgatcgatggagttcaaatgtcgaagggtaggaagcgccacacgaagcttgcttgttgtgcaaaacaggcgcctttcttttgcttgcagccgagacattgaagacacagtaatagaacacaaaagaatgggtaagaagggaaagtggtttagtgctgtgaagaaagtcttcggctcctccgatccagatggaaagcaagcaaaggctgagaaggcggacaagtcaaaatccaggaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttgagaaaatgaagattgatgaagactgggatcacagccatcaatccaaagaacaaattgaggccagcctagttatgaaacaagaagctgcgctaagacgagaaagagcactcgcatatgcgttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccggccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcagagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaataagcgcctctccttcccagtcattgacaaaccgagccgtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtaccatataacggtttttgacagactttcttaacgtgtgaaaactgcaatatttagccattccg

SEQ ID NO: 115 - protein, 498 aa, Panicum virgatum
  misc_feature (1)..(498): Ceres Clone ID no. 2034697
  misc_feature (1)..(498): Bit score of 849.2 for HMM based on sequences of Figure 4
  misc_feature (1)..(498): Functional Homolog Of SEQ ID NO. 111
  misc_feature (1)..(498): in Figure 4
  misc_feature (141)..(159): Pfam Name: IQ Pfam Description: IQ calmodulin-binding motif
  misc_feature (372)..(479): Pfam Name: DUF4005 Pfam Description: Protein of unknown function (DUF4005)
MGKKGKWFSAVKKVFGSSDPDGKQAKAEKADKSKSRRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELEKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVNKRLSFPVIDKPSRPPADKPKERVRRHSDPPKVDPATLKDAPVA

SEQ ID NO: 116 - protein, 500 aa, Oryza sativa
  misc_feature (1)..(500): Public GI ID no. 115440873
  misc_feature (1)..(500): Oryza sativa Japonica Group
  misc_feature (1)..(500): Bit score of 851.8 for HMM based on sequences of Figure 4
  misc_feature (1)..(500): Functional Homolog Of SEQ ID NO. 111
  misc_feature (1)..(500): in Figure 4
  misc_feature (144)..(162): Pfam Name: IQ Pfam Description: IQ calmodulin-binding motif
  misc_feature (374)..(478): Pfam Name: DUF4005 Pfam Description: Protein of unknown function (DUF4005)
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQVETSLMMKQEAALRRERALAYAFSHQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 117 - protein, 492 aa, Brachypodium distachyon
  misc_feature (1)..(492): Public GI ID no. 357125736
  misc_feature (1)..(492): Bit score of 841.5 for HMM based on sequences of Figure 4
  misc_feature (1)..(492): Functional Homolog Of SEQ ID NO. 111
  misc_feature (1)..(492): in Figure 4
  misc_feature (142)..(160): Pfam Name: IQ Pfam Description: IQ calmodulin-binding motif
  misc_feature (382)..(476): Pfam Name: DUF4005 Pfam Description: Protein of unknown function (DUF4005)
MGKKGKWFSAVRRVFSSSDPEAKEAKAEKADKPKSRKKWPFGKSKHSDLPTSTVSGITLVAPQPLPPPPTQPPQPQSEEIKDVKTIEAESEQNKHAYSVALASAVAAEAAAVAAQAAAEVVRLTAVTTSTPKAAVCSKEELAAVKIQTAFRGYLARRALRALRGLVRLKSLVDGNSVKRQTSHTLHCTQTMTRVQTQIYSRRVKLEEEKQALQRQLQLKHQRELEKMKIDEDWDHSHQSKEQIEASLMMKQEAALRRERALAYAFSHQWKNSGRTITPTFTDQGNPNWGWSWMERWMTARPWENRVVPNKDPKDSVLTKNPSTSAIRTFVPRALSIQRPATPSKSSRPPSRQSPSTPPSKVPSVAGKFRPSSPRDSWLYRDDDLRSITSIRSERPRRQSTGGTSVQDDASLTSTPALPSYMQSTKSARAKSRYHSGFTDKFEVPERVSLVHSSIKKRLSFPAADKPNIAPADKPMERARRHSEPPKVDPASL

SEQ ID NO: 118 - protein, 482 aa, Vitis vinifera
  misc_feature (1)..(482): Public GI ID no. 225449126
  misc_feature (1)..(482): Bit score of 823.7 for HMM based on sequences of Figure 4
  misc_feature (1)..(482): Functional Homolog Of SEQ ID NO. 111
  misc_feature (1)..(482): in Figure 4
  misc_feature (119)..(137): Pfam Name: IQ Pfam Description: IQ calmodulin-binding motif
  misc_feature (373)..(467): Pfam Name: DUF4005 Pfam Description: Protein of unknown function (DUF4005)
MGKKGNWFSAVKKALSPEPKEKKDKTTPKSKKKWFGKHKNLDPVSSSTENAMPLPAPAPPIEDVKLTEAENEQSKHAYSVALATAVAAEAAVAAAHAAAEVVRLTTVTRFSGKSKEEVAAIKIQTAFRGYLARRALRALRGLVRLKSLIQGQSVKRQATTTLRCMQTLARVQSQIRARRIRMSEENLALQRQLQLKRDKELEKLRASMGDDWDDSVQSKEQIEANLQSKQEAAVRRERALAYAFSHQQTWKNSSKPANPTFMDPNNPHWGWSWLERWMAARPWESRSAMEKELNTDHASLKSTTSRAFSIGEISKAYARRDLNLDKKPSPTAQKPSRPPSRQSPSTPPSKAQSSSSVTGKTKPASPKGSGWGADDDSRSMLSIQSERYRRHSIAGSLVRDDESLASSPAVPSYMASTESTRARSRLPSPLGLEKNGTPEKASGSSAKKRLSFPASPAGPRRHSGPPRVETSSIKAISPAHRG

SEQ ID NO: 119 - DNA, 1470 bp, Populus trichocarpa
  misc_feature (1)..(1470): Ceres Annot ID no. 1465047
  misc_feature (1)..(1470): Encodes the peptide sequence at SEQ ID NO. 120
atggggaaaagagggagttggttctctgctttgaagaaagccctcggttcctctaagaaatccaaatcaaagaagaaatggtcagaaaaagagaagaaccgggatctaggtgtttcttcacatgaagaaaccgttgcaccctctctttctcctcctcgtacaccacctcctcctacagcagaagatgtgaaattaactgaagctgagaacgagcagagcaagcatgcttattccgtggcgcttgccactgctgtggcagctgaggcagctgttgcagccgcccaggctgccgctgaggttgttcggcttactacagtggcacattactctggaaaatcgaaggaggaaatagctgcaatcaggattcaaacagcatttagaggatacctggcgaggagggcattacgtgctttgagagggctggtgagattgaagtcattgatacaagggcaatctgtcaaacggcaagcaactgccacattacgagccatgcagactcttgctcgtgtgcagtctcagattcgtgcaagaaggatcagaatgtccgaggaaaatgaggccctccaacggcagctccagcagaaacatgacaaagaacttgagaagttgagaacttctattggagaacaatgggatgatagcccacaatcaaaggaagaagttgaagccagcctactacaaaagcaagaagctgccatgagaagagaaagggcactggcttatgcatactcgcatcagcaaatgtggaagcaatcttcaaaatcagcaaatgctacattcatggatccaaacaatcctcgttggggatggagttggttagagaggtggatggcagcccgaccttgggagagccgaagcacaatagataacaatgatcgggcctctgttaagagtacaacaagccgtaccatgtctcttggagaaatcagcagagcttattctcgtcgtgatcttaaccatgacaataaagcttctcctggtgcgcaaaaatcaagtcggcctcccagtcggcaatcaccttctactcccccctctaaggcaccatctacatcttcagtaacagggaaagcaaagccaccaagccctagagggagtgcttggggaggagacgaggactccaggagcacattcagtgtccagtctgagcgctatcggagacatagcatagcagggtcatcaataagagatgatgagagtcttgcaagttcgccttcagttccaagttacatggcacccacacggtcacagtcagcaaaggcaaaatcccgcttgtcaagcccgttaggcatagataataatgggacaccagataaggcatcagtgggttatgtaaagaagcggctttccttctctgcttcaccagctggagcaaggagacactctggtcctcctagggtggatgccagtgctgttaaagacattcaaatgcacagagaagagaaaatgagcaatggagcaagcagcaagtag

SEQ ID NO: 120 - protein, 489 aa, Populus trichocarpa
  misc_feature (1)..(489): Ceres Annot ID no. 1465047
  misc_feature (1)..(489): Bit score of 810.6 for HMM based on sequences of Figure 4
  misc_feature (1)..(489): Functional Homolog Of SEQ ID NO. 111
  misc_feature (1)..(489): in Figure 4
  misc_feature (118)..(136): Pfam Name: IQ Pfam Description: IQ calmodulin-binding motif
  misc_feature (371)..(471): Pfam Name: DUF4005 Pfam Description: Protein of unknown function (DUF4005)
MGKRGSWFSALKKALGSSKKSKSKKKWSEKEKNRDLGVSSHEETVAPSLSPPRTPPPPTAEDVKLTEAENEQSKHAYSVALATAVAAEAAVAAAQAAAEVVRLTTVAHYSGKSKEEIAAIRIQTAFRGYLARRALRALRGLVRLKSLIQGQSVKRQATATLRAMQTLARVQSQIRARRIRMSEENEALQRQLQQKHDKELEKLRTSIGEQWDDSPQSKEEVEASLLQKQEAAMRRERALAYAYSHQQMWKQSSKSANATFMDPNNPRWGWSWLERWMAARPWESRSTIDNNDRASVKSTTSRTMSLGEISRAYSRRDLNHDNKASPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAVKDIQMHREEKMSNGASSK

SEQ ID NO: 121 - DNA, 1876 bp, Gossypium hirsutum
  misc_feature (1)..(1876): Ceres Clone ID no. 1919901
  misc_feature (1)..(1876): Encodes the peptide sequence at SEQ ID NO. 122
aacttttcttagttatcctctgcaaatgccaacctgttcttttattattattttccgccatttttgctctctttcaagcattttttttttgcctagatccacttctctctctttgatttttaattactgcatttttgttttaatacacaataagaacaactaagagatagaatgtgacttatcaatcttttaactgagatctgtgagaatttttctatgtaccaaggaattatttacagatgggaaaaaaaggtggctggctttctattgtgaagaaagctttgagccctgaatccaagaaatctcagcaccaaactccaaagccaaagaaaaaatggttcggaaaaagcaaaaatttgagccctgtgtctgtgcctgaagaaactgaagtgataactgaagatgcaaagctaaaagaagctgaaaacgaacaaagcaaacatgcctactctgtggctcttgccaccgctgtggcggccgaggcagcggtggcagctgctcaggcggctgctgaagttgtccgtctcacttctcagccgcgccatctggggaagtcaaaggaggaaatagctgctatcaggattcaaacagcatttcgtggatatttggctaggagggcactgcgagctttgagagggttggtaaggttgaaatcgttgatcagagggcaatccgtcaaacgccaagcaactacaacgttaagatgcatgcagactctagctcgtctgcagtctgagatttctgcaaggaggattagaatgtcagaagagaaccaggctcttcagcgccagcttcaacagaaatgccagaaagagctcgagaagttgagagctcccatgagagaagactggaacgatagtacacagtcgaaggagcagatcgaagcaagacaacaaaataagcaaggagctactatgaaaagggaaagagcattggcttatgcatactgtcaccagcgatcgtggaagaactgttctagatcagtgaatcaaacatttatggatccgagtaattcacactggggttggagttggttagagcgatggatggcagcccgaccatgggaagtccaaagcacaactgataacaatgaccgtggctcagtcaagagtatgggtgcttgttcgatatctataagtgaaatcagcagagcttattctcgaagagatcttaacaatgataacaaaccatctccaacacctcagaagtcaagtcgagttcctagccgccagtctccatcgactccaccttcaaaggcaccttcgatttcatcggtttctggtaaaacaagactgccaagtccgagaggaagtcaatggggagggtatgaagactcaaggagcatactcagtacccggtctgatcgttataggagacatagcattgcagggtcctcaatgagagacgatgagagccttacaagctcacctgcagttccaagttatatggcaccaacacagtccacaaaggccaggtcccacataccaagccccttaggaagtggcacaccagataggagagtggcagggtctgcaaagaaacggcttttgttcccagcatccccagccagtagtaggagacattcagagcctcctaaagtggacataagtgaggctagaaagaatcagcatgcaccaagcaatggaaggcaagtggcttggtgaagagtgcaacaaaagttagattgaataaacatggaagggttatttcaacttgaagttcttgtagtgtggttgtgattatctttttcttcctaggttttatgattattaattataaaagggttacttttttctgggtgagatttagtttattgtttgtggttgacaaacattcttaaaaatcttcaagtttagtttcaattcatgaaatttgt

SEQ ID NO: 122 - protein, 474 aa, Gossypium hirsutum
  misc_feature (1)..(474): Ceres Clone ID no. 1919901
  misc_feature (1)..(474): Bit score of 763.6 for HMM based on sequences of Figure 4
  misc_feature (1)..(474): Functional Homolog Of SEQ ID NO. 111
  misc_feature (1)..(474): in Figure 4
  misc_feature (111)..(129): Pfam Name: IQ Pfam Description: IQ calmodulin-binding motif
  misc_feature (366)..(462): Pfam Name: DUF4005 Pfam Description: Protein of unknown function (DUF4005)
MGKKGGWLSIVKKALSPESKKSQHQTPKPKKKWFGKSKNLSPVSVPEETEVITEDAKLKEAENEQSKHAYSVALATAVAAEAAVAAAQAAAEVVRLTSQPRHLGKSKEEIAAIRIQTAFRGYLARRALRALRGLVRLKSLIRGQSVKRQATTTLRCMQTLARLQSEISARRIRMSEENQALQRQLQQKCQKELEKLRAPMREDWNDSTQSKEQIEARQQNKQGATMKRERALAYAYCHQRSWKNCSRSVNQTFMDPSNSHWGWSWLERWMAARPWEVQSTTDNNDRGSVKSMGACSISISEISRAYSRRDLNNDNKPSPTPQKSSRVPSRQSPSTPPSKAPSISSVSGKTRLPSPRGSQWGGYEDSRSILSTRSDRYRRHSIAGSSMRDDESLTSSPAVPSYMAPTQSTKARSHIPSPLGSGTPDRRVAGSAKKRLLFPASPASSRRHSEPPKVDISEARKNQHAPSNGRQVAW

SEQ ID NO: 123 - protein, 444 aa, Glycine max
  misc_feature (1)..(444): Public GI ID no. 356565733
  misc_feature (1)..(444): Bit score of 714.3 for HMM based on sequences of Figure 4
  misc_feature (1)..(444): Functional Homolog Of SEQ ID NO. 111
  misc_feature (1)..(444): in Figure 4
  misc_feature (107)..(125): Pfam Name: IQ Pfam Description: IQ calmodulin-binding motif
  misc_feature (354)..(437): Pfam Name: DUF4005 Pfam Description: Protein of unknown function (DUF4005)
MGKKGSWFSAVKKVFSSDSKKDKKKQKSDKSKKASSDKDAEAAVVLPPIEDAKLIEAEKEQSKHAASLAFATAVAAEAAVAAAQAAAEVVRLTSMPHYTGRTKEEIAAIKVQTAFRGYMARRALRALRGLVRLKTLVQGQSVKRQAASTLRSMQTLARLQSQIRERRIRMSEENQALQRQLHQKHEKELEKLRAAVGEEWDDSSQSKEQIEAKLLHRQEAALRRERALAYSFSHQQTWKGSSKSLNPTFMDPNNPQWGWSWLERWMATRPWDGHSTVVDHNDHASVKSAASRAVSVGQITKLYSLQDKKPSPFGSKARRPAPQSSHSKAPSTNGKARPSSSTKGSSVWGGDEDSRSMFSVQSERYRRHSIAGSSVRDDDSLASTPAIPSYMAATSSAKARSKIIRHSPEKKGGGGSVSARKRLSFSPSSAANSRRHSDPPKVEM

SEQ ID NO: 124 - protein, 430 aa, Arabidopsis thaliana
  misc_feature (1)..(430): Public GI ID no. 15231175
  misc_feature (1)..(430): Bit score of 539.6 for HMM based on sequences of Figure 4
  misc_feature (1)..(430): Functional Homolog Of SEQ ID NO. 111
  misc_feature (1)..(430): in Figure 4
  misc_feature (110)..(128): Pfam Name: IQ Pfam Description: IQ calmodulin-binding motif
  misc_feature (339)..(408): Pfam Name: DUF4005 Pfam Description: Protein of unknown function (DUF4005)
MGKSWFSAVKKALSPEPKQKKEQKPHKSKKWFGKSKKLDVTNSGAAYSPRTVKDAKLKEIEEQQSRHAYSVAIATAAAAEAAVAAAQAAAEVVRLSALSRFPGKSMEEIAAIKIQTAFRGYMARRALRALRGLVRLKSLVQGKCVRRQATSTLQSMQTLARVQYQIRERRLRLSEDKQALTRQLQQKHNKDFDKTGENWNDSTLSREKVEANMLNKQVATMRREKALAYAFSHQNTWKNSTKMGSQTFMDPNNPHWGWSWLERWMAARPNENHSLTPDNAEKDSSARSVASRAMSEMIPRGKNLSPRGKTPNSRRGSSPRVRQVPSEDSNSIVSFQSEQPCNRRHSTCGSIPSTRDDESFTSSFSQSVPGYMAPTQAAKARARFSNLSPLSSEKTAKKRLSFSGSPKTVRRFSGPPKLESNVTKKDTNLA

SEQ ID NO: 125 - DNA, 1918 bp, Arabidopsis thaliana
  misc_feature (1)..(1918): Ceres Clone ID no. 106263
  misc_feature (1)..(1918): Encodes the peptide sequence at SEQ ID NO. 126
acaaatactcttcttcacacagctttgaatccatctgtcttctcctctctctctcttctccatttgcaattacgataatgtgaaagcaataagaagaggaaaagttatcttcgcacctcagcaaagatccaatcgattcgattcttaagctttttcgtcttctccgataaggtcactacttagaagccgcgttgtggtttagttgactcctccaggttttatcttcaagctttttcgtctatcagatctggtgtcactgtcttctcataggattacatagagatggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgttcctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggatgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcagcaaaactggaagaacaactctaaatctggaaacccgatgttcatggatccaagcaacccgacatggggttggagctggttggagagatggatggctggtaggccactagagagttccgagaaagaacaaagcaacagcaacaatgacaatgctgcctcggtcaagggctctattaaccgcaacgaagctgcaaaatctctaacccgcaatggctcaactcaaccaaacacaccatcatccgcaagagggaccccaagaaacaaaaacagtttcttctcacctccaactccctcaaggctaaaccaatcctcgaggaaatccaatgacgacgactccaaaagcacaatctcggtcctgtccgagaggaaccgcagacacagcattgctggttcatcagtcagagacgatgagagcctcgctggctcaccagctctcccgagctacatggttccaactaaatcagctcgagccaggctcaagccccaaagcccattaggtggtaccacacaggaaaacgaagggttcacagacaaggcatcagctaagaaacggctctcgtatccaacttcgcctgcattgcctaaaccacggcggttctcagctccccctaaggtggagagtggcggcgttaccgtgaccaacggagcaggcagctgaggtattttatttaatataattattttcccacttatgaatgtgtccgagattgttgtctcttatgtgttcccttcatttcgtaattcatttgtgcagtgtaagcgccagtcatttatttttttactataataaattttataaccttttaaaattcatgttcttttgtttctttgaatatttaagttatttttattaatgttggatgaattggaatatgatgatgttatttgtattgtaatgcagatccttt

SEQ ID NO: 126 - protein, 461 aa, Arabidopsis thaliana
  misc_feature (1)..(461): Ceres Clone ID no. 106263
  misc_feature (1)..(461): Bit score of 469.2 for HMM based on sequences of Figure 4
  misc_feature (1)..(461): Functional Homolog Of SEQ ID NO. 111
  misc_feature (88)..(88): Xaa can be any naturally occurring amino acid
  misc_feature (116)..(135): Pfam Name: IQ Pfam Description: IQ calmodulin-binding motif
  misc_feature (180)..(180): Xaa can be any naturally occurring amino acid
  misc_feature (243)..(243): Xaa can be any naturally occurring amino acid
  misc_feature (346)..(438): Pfam Name: DUF4005 Pfam Description: Protein of unknown function (DUF4005)
  misc_feature (370)..(370): Xaa can be any naturally occurring amino acid
  misc_feature (377)..(377): Xaa can be any naturally occurring amino acid
MGKKAKWFSSVKKAFSPDSKKSKQKLAEGQNGVISNPPVVDNVRQSSSSPPPALAPREVRVAEVIVERNRDLSPPSTADAVNVTATDXPVVPSSSAPGVVRRATPTRFAGKSNEEAAAILIQTIFRGYLARRALRAMRGLVRLKLLMEGSVVKRQAANTLKCMQTLSRVQSQIRARRIRXSEENQARQKQLLQKHAKELAGLKNGDNWNDSIQSKEKVEANLLSKYEATMRRERALAYSYSHXQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHXIAGSSVXDDESLAGSPALPSYMVPTKSARARLKPQSPLGGTTQENEGFTDKASAKKRLSYPTSPALPKPRRFSAPPKVESGGVTVTNGAGS

SEQ ID NO: 127 - DNA, 1788 bp, Zea mays
  misc_feature (1)..(1788): Ceres Annot ID no. 247223212
  misc_feature (1)..(1788): Encodes the peptide sequence at SEQ ID NO. 128
gacgcatcgcaacgccaacactcacagttgactatcccaccaaggttcaggcaggggagagtgcctgtttcgatggggaagaagggcaagtggttcggcgccgtcaagaaggtcttcagccctgaatccaaggagaagaaagaggagaggctaaggaggaagtcagcagctagcaacccgacgccggtagatctgaccccgtctacctccttggaagtcaatctttcggtgccaccgcctccagctcctcccccagttcttcaccaggccgaggaggttggggtccctgaagccgagcaggagcagagcaagcatgtcgccgtggaggaggcccctgctgccgccccagcgcaggcgtcggtgctgccacctgctgtgccaacccaggagctcgccgcagtcaagatccagaccgccttccgaggttacctggcaaggagggcactacgagcactgcgaggccttgttcgattgaagtcattggttgagggtaattcagtaaagcgtcaatctgcaagcactctgcgctgcatgcaaactctatcacgggtgcagtcacagatatcttccaggagagcaaagatgtccgaggagaaccaggctctccaacgccagctcctacttaaacaggaactggagaatttcagaatgggtgagaactgggatgacagcacccaatccaaggagcaaatcgaggcaagcctgataagcaggcaagaggcggcgataagaagagaaagagcgcttgcatatgcattttcacaccagtggaagagtacatcgagatctgtcaacccaatgtttgtagacccaaacaacctgcagtggggctggagctggctggagcgctggatggcagcaaaaccatgggaaggccgcaatggggctgacaaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatttgtcacgcccaagaacgggctttcacaggtggacgatgacgcgaggagcgtgctcagtgtgcagtctgagcggccaagaaggcacagtatagccacctcgactgtgcgggacgacgagagcctcacgagctccccgtcgctcccaagctacatggttcccacagaatctgcaagggccaaatctcgcctccagggttcagcaacggccaatggcgcagagacacctgagaaaggaggctcgactggaccagccaagaagaggttatccttccagggtggaactgtgtctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacaggtcctctatttatgtgagacatatatttcttttctttcagaagatccccttgaagtgtgttacccttgcaagct

SEQ ID NO: 128 - protein, 467 aa, Zea mays
  misc_feature (1)..(467): Ceres Annot ID no. 247223212
  misc_feature (1)..(467): Bit score of 543.3 for HMM based on sequences of Figure 4
  misc_feature (1)..(467): Functional Homolog Of SEQ ID NO. 111
  misc_feature (108)..(126): Pfam Name: IQ Pfam Description: IQ calmodulin-binding motif
  misc_feature (352)..(441): Pfam Name: DUF4005 Pfam Description: Protein of unknown function (DUF4005)
MGKKGKWFGAVKKVFSPESKEKKEERLRRKSAASNPTPVDLTPSTSLEVNLSVPPPPAPPPVLHQAEEVGVPEAEQEQSKHVAVEEAPAAAPAQASVLPPAVPTQELAAVKIQTAFRGYLARRALRALRGLVRLKSLVEGNSVKRQSASTLRCMQTLSRVQSQISSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNIDRGSVKSMSLNLGEGEITKAFNRRDSKLEKPSPPTPRPARPTSRHSPLTPSARVAPIPARRKFVTPKNGLSQVDDDARSVLSVQSERPRRHSIATSTVRDDESLTSSPSLPSYMVPTESARAKSRLQGSATANGAETPEKGGSTGPAKKRLSFQGGTVSASPMRRHSGPPKVEIAPPQPEALVVNGGSK

SEQ ID NO: 129 - DNA, 1745 bp, Glycine max
  misc_feature (1)..(1745): Ceres Annot ID no. 200200100
  misc_feature (1)..(1745): Encodes the peptide sequence at SEQ ID NO. 130
cttcacacattagtggttaatttgatactttgaacatggtaaagcagctccgggcccaccgtgagcaacccaagtggcaaggtctctcaatattagcagaaacagctggtcctataattcaaactatcctctatcagcatttggcaagatctgatttccctcttcacaaggagagaaagagaaaggcatagtttgctgcaggtttgatcttcaagttgcaatctttttgttgtctcgactgggtaagaagaacatatttgagatctgtcactttgtttcagtccaggattaaactaaggaatgccaagaaaatggggaggaagggaaattggttttctagtgtgaagaaagctctcagccctgactcgaaggagaagaaagatcagaaatcaagtaaatctaagaagaaatggtttgggaagcaaaaatttgagacttcagtctcatactcagaagctgataaagcaccaccaccaccacctcctattcctccaccagaagagattaaattaactgatattgaacatgaaatcagtcatgatcacgatcaagttgttgaagttgcaactgccatggatgctgaggaacttgttccttctgttcaaatagaacctgttagggttgaagctgccctaattgctcattttgccggtaaaccaaaggatgaagtggcagctatcaaaattcaaacagcttttcgtggatacttggcaagaagagcattgcgggctttaagggggctggtcaggttgaaattattgatggaagggccggttgttaaacgccaagccacaagtaccctccgctctatgcagacattatctcgcttgcagtctcagattcgttccaggaggatcagaatgttagaggagaatcaggctctgcagaggcagctcttacagaaacatgctagagagcttgagagcttgcggatgggagaagaatgggatgacagcctacaatcaaaagaacaaatcgaagccaagttactaagcaagtatgaggctactatgagaagagaaagagcactggcttatgcattcactcatcagcaaaactggaagaactcgtctagatctgtaaatccaatgtttatggatccaactaatccgagctggggttggagctggttggaacgatggatggcagcccgaccttgggagagccgtagccatatggataaagagttgaatgaccactcctccataagaagctcaagccgcagcattaccggtggagaaatcagcaagtcatttgctcgtttccagctcaattcggaaaagcactctccaacagccagccagaatcctggctcccctagctttcagtccactccttccaagccagcttcatcatctgctaagaaaccaaagaaggtaagtccaagcccaaggggcagctgggttatggacgaggactccaaaagcttggtcagtgtacactctgaccggttccggaggcactccattgccggttcatcggtgagagatgacgagagccttgctagctctccagcagttccaagctacatggtgccaactcaatctgcaaaagccaagtccaggacacaaagtccattagcctcagaaaatgcaaaagcagagaaaggttcctttgggagtgcaaagaagcggctttctttcccagcttcacctgccaggccaaggcgccattcaggtccaccaaaggttgaaagcagcagcttaaatgcagagttagctgtggacaagggtgtggacagttga

SEQ ID NO: 130 - protein, 477 aa, Glycine max
  misc_feature (1)..(218): Ceres Annot ID no. 200200100
  misc_feature (1)..(477): Bit score of 607.8 for HMM based on sequences of Figure 4
  misc_feature (1)..(477): Functional Homolog Of SEQ ID NO. 111
  misc_feature (121)..(139): Pfam Name: IQ Pfam Description: IQ calmodulin-binding motif
  misc_feature (375)..(458): Pfam Name: DUF4005 Pfam Description: Protein of unknown function (DUF4005)
MGRKGNWFSSVKKALSPDSKEKKDQKSSKSKKKWFGKQKFETSVSYSEADKAPPPPPPIPPPEEIKLTDIEHEISHDHDQVVEVATAMDAEELVPSVQIEPVRVEAALIAHFAGKPKDEVAAIKIQTAFRGYLARRALRALRGLVRLKLLMEGPVVKRQATSTLRSMQTLSRLQSQIRSRRIRMLEENQALQRQLLQKHARELESLRMGEEWDDSLQSKEQIEAKLLSKYEATMRRERALAYAFTHQQNWKNSSRSVNPMFMDPTNPSWGWSWLERWMAARPWESRSHMDKELNDHSSIRSSSRSITGGEISKSFARFQLNSEKHSPTASQNPGSPSFQSTPSKPASSSAKKPKKVSPSPRGSWVMDEDSKSLVSVHSDRFRRHSIAGSSVRDDESLASSPAVPSYMVPTQSAKAKSRTQSPLASENAKAEKGSFGSAKKRLSFPASPARPRRHSGPPKVESSSLNAELAVDKGVDS

SEQ ID NO: 131 - protein, 445 aa, Arabidopsis thaliana
  misc_feature (1)..(445): Public GI ID no. 7413581
  misc_feature (1)..(445): Bit score of 414.1 for HMM based on sequences of Figure 4
  misc_feature (1)..(445): Functional Homolog Of SEQ ID NO. 111
  misc_feature (115)..(134): Pfam Name: IQ Pfam Description: IQ calmodulin-binding motif
  misc_feature (330)..(422): Pfam Name: DUF4005 Pfam Description: Protein of unknown function (DUF4005)
MGKKAKWFSSVKKAFSPDSKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWVPRKNKSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 132 - DNA, 1806 bp, Zea mays
  misc_feature (1)..(1806): Ceres Clone ID no. 228069
  misc_feature (1)..(1806): Encodes the peptide sequence at SEQ ID NO. 133
gagccgcggaggagcagcggcgcatcgcaacactaaccaaagtcctcctctccaggtgccgagccagggtgactgttccgaggagcgtggcgtggacccatggggaagaagggcaagtggttcggtgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaggaggcccctgctgctgctgctgccccagcacaggcgtcggtgctgccacctggtgcgccaaccgaagagctcgccgcaatcaagatccagaccgccttccgaggttacctggcaaggagggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagagctcttgcatatgcattttcacatcagtggaagagcacatcaagatctgcgaacccaatgtttgtagacccaaataacttgcagtggggctggagctggttggagcgctggatggcagcaaaaccttgggagggacgcaatgggaccgacaaggagagcaacattgatcgcggctccgtcaagaatatgagcttgaaccttggagttggagagggtgagatcacaaaagctttcaaccgccgggactcaaagccagagaagccatcaccaccgactccaaaaccggcccgtccagcttccaggcaatccccttcgacgccctctgctagagtggccccaatacctgcgaggaggaaatccagcacgccaaagaatgggctttcacaggtggacgatgacgtgaggagcgtgctcagtgtgcagtctgagcgaccaaggaggcacagcatagccacgacgtcgaccatgcgggacgatgagagcctcgcgagctccccgtcgctcccgagctacatggttcccacagaatctgcgagggccaaatctcgcacagcaacggccaatggcgcagagacgcctgagaaaggaggctctgctggaccagtcaagaagaggttgtctttccaaggtggagctgcggctgcctcaccgatgcgacggcattctggccctcccaaggtggagagcgctgtgaaggacattgctgcgccaccacagcctgaggccttggtagccaatggtggtggaagcaagtgacttgtattgacaagttccaggatgggggagcgggttatggtcttatggagggacatgtttcatccgtgaacagaagttaagagtggtgccggatctacgaatggtttgaattgttttcccgttacaaccacattgtttgctgtataagattcactgtacctgccagttggttccatttgttgttttctgtaaaacaaacatcaatttgtcactagaatctgtgatgcttgtatgtaaacaggtcctctatttatgtgagccatatatttcattttc

SEQ ID NO: 133 - protein, 476 aa, Zea mays
  misc_feature (1)..(476): Ceres Clone ID no. 228069
  misc_feature (1)..(476): Bit score of 555.7 for HMM based on sequences of Figure 4
  misc_feature (1)..(476): Functional Homolog Of SEQ ID NO. 111
  misc_feature (110)..(128): Pfam Name: IQ Pfam Description: IQ calmodulin-binding motif
  misc_feature (361)..(446): Pfam Name: DUF4005 Pfam Description: Protein of unknown function (DUF4005)
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQASVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 134 - DNA, 1703 bp, Glycine max
  misc_feature (1)..(1703): Ceres Clone ID no. 467508
  misc_feature (1)..(1703): Encodes the peptide sequence at SEQ ID NO. 135
aaaccatcctctcttagcatttggcaagatctgatttccctcttcacaaggagagaaatagaaaggcatatgatcttcttcaagttgcaatctttttagagagagagggttagaagaacaacatacttgagatctgtcactttgtttgagttcagatcttcaaagtttccttccttgttcttttggtgcaaaggatcaaattaaggaatgccaaatggggaggaaggggaattggttttccagtgtgatgaaagctctcagtcctgactcaaaggagaagaaagaacagaaatcaagtaaatctaagaagaaatggtttgggaagcaaaaattggagacttcagtctcatactcagaagctcataaagcaccaccaccaccgcgacctattcctccaccagaagcgattaaattaactgatattgaaaatgaaatcagtcatgatcacgactatgttgttgaagttgcaactgccatggatgccgaggaacctgttccttctgttcagatagaacctgttagggttgaagctgccccaattgctcattatgctggtaaaccaaaggatgaagtggcagctatcaaaattcaaacagcttttcgtggatacttggcaagaagagcattgcgggctttaagggggctggtcaggttgaaattattgatggaagggccagttgttaaacgccaagccacaagtaccctccactctatgcagacattatctcgcttgcagtctcagattcgttcaaggaggatcagaatgttagaggagaatcaggctctgcagagacagctcttacagaagcatgcaagagagcttgagagcttgcggatgggagaggaatgggatgacagcctacaatcaaaagaacaaatcgaagccaagttacttagcaagtatgaagctactacgagaagagaaagagcgctggcttatgcattcactcatcagcaaaattggaagaactcatctagatctgtaaatccaatgttcatggatccaaccaatccaagctggggttggagctggttggaacgatggatggcagcccgaccttgggagagccgtagccatatggataaagagttgaatgaccactcatccgtaagaagctcaagccgcagtattaccggtggagaaatcagcaagtcatttgctcgtttccagctcaatttggaaaagcactctccaacagcctgccagaatcctggctcacctagctttcagtccactccttccaagccagcttcaatatctgctaagaaaccaaagaaggtaagtccaagcccaaggggcagctgggttacagacgaggactccaaaagcttggtcagtgtacagtcagaccggttccggaggcactccattgccggttcattggtgagagatgatgagagccttgctagctctccagcagttccaagctacatggtgccaactcaatctgcaaaagccaagtccaggacacaaagtccattagccccagaaaatggaaaagcagagaaaggttcctttgggagtgcgaagaagcggctttctttcccagcttcacctgccaggccaaggcgccattcaggtccaccaaaggtagaaagcagcagcttaaatgcagagttagctgtggacaagggtgtggacagttgatcatacaagtaaaaggatggaaaaacattaaagtaggattgaaaatatatcactg

SEQ ID NO: 135 - protein, 477 aa, Glycine max
  misc_feature (1)..(477): Ceres Clone ID no. 467508
  misc_feature (1)..(477): Bit score of 605.0 for HMM based on sequences of Figure 4
  misc_feature (1)..(477): Functional Homolog Of SEQ ID NO. 111
  misc_feature (121)..(139): Pfam Name: IQ Pfam Description: IQ calmodulin-binding motif
  misc_feature (368)..(458): Pfam Name: DUF4005 Pfam Description: Protein of unknown function (DUF4005)
MGRKGNWFSSVMKALSPDSKEKKEQKSSKSKKKWFGKQKLETSVSYSEAHKAPPPPRPIPPPEAIKLTDIENEISHDHDYVVEVATAMDAEEPVPSVQIEPVRVEAAPIAHYAGKPKDEVAAIKIQTAFRGYLARRALRALRGLVRLKLLMEGPVVKRQATSTLHSMQTLSRLQSQIRSRRIRMLEENQALQRQLLQKHARELESLRMGEEWDDSLQSKEQIEAKLLSKYEATTRRERALAYAFTHQQNWKNSSRSVNPMFMDPTNPSWGWSWLERWMAARPWESRSHMDKELNDHSSVRSSSRSITGGEISKSFARFQLNLEKHSPTACQNPGSPSFQSTPSKPASISAKKPKKVSPSPRGSWVTDEDSKSLVSVQSDRFRRHSIAGSLVRDDESLASSPAVPSYMVPTQSAKAKSRTQSPLAPENGKAEKGSFGSAKKRLSFPASPARPRRHSGPPKVESSSLNAELAVDKGVDS

SEQ ID NO: 136 - DNA, 1475 bp, Gossypium hirsutum
  misc_feature (1)..(1475): Ceres Clone ID no. 1829581
  misc_feature (1)..(1475): Encodes the peptide sequence at SEQ ID NO. 137
attattttcaatgcaatttaagagttttatttattttatgttataaattttttaacctctaaatatgatttgaaatgttaattccattggttgtttttggttttgaaggagaatttattgaggaatgggcaaaaaaggaagctggtttactgctgtgaagaaagttctaagccttgaacccaacaaagaagagaagattcaaaaatccaagaaaaatggggttaaattacctgagaagatcaaaggaagcaaacgtgacaactggttcgctccggccaccaccatggtgaccggcgcgttggttcgccttactttgtcgccacactacttgggaaaatcaatggaggaaatagctactgttaagattcaaactgtgtttcgaggatacctggcgaggaaggcattgcgagatttgagagggttagagaggttgaaatcattgatacaagggcaatccatgaaacgacaagccactattacgttacgatgcatgcggacacttgctcgagtgcagtcccaaactcgaacaaggcaactcagagtgtctgaacaaaaccgagcacttcaaaagcatcttcaaactaaatacgaaaaacagttgcaaaattccaaatcttacatgggagaagattggaatgtaagtactaagtctaaagagcaaatgcaagcaaaacaacaatatagacaagtagcagccatgcgaagggagagagctttagcttactcatttactcatcagcgatcctggaaggtcacttgtagatcgatgaatcacacatctatggatccatttaatcctaaatggagctggagttggttagagcgatggatgtcaactcgaccatgggagattcaaaatgcaccggataacaatgatcatggcccaagtaagagtgttggtgctgagataaccaaagctaagtctcaaagtgatgttaacaatgatcacaataaacaatcttcaacaccggcaaaaccgattcgacctccgaaccgtaggtcctcttcgactccaccgtctaaaacgcattctatttctagcaagaagggattggaaagccccagtccgacacgaattcagttgcctgattgttacaagaggcatagcatcggaggcttatcattggagagagacgatgaggtctttgcaaactcaccacctaataataaaataccggcacgttcgtcatcaaaggaccggtctcgaccaccgagcattaatagaaatccagttaatactaggagacattctggtcctccgaaagttgatattttttccaactaaggaagaaatgccaaacaatgacaaaggcaggtagtttatgaagcatagacactttagtcgcgagtgccggccacatgtttaatattgaaatggctccgacacaatcaaatgtgtgttggttatatgacgatatattttttcaaaaaatcaaatactatcagaaaaaaatataaagaaagattaattggat

SEQ ID NO: 137 - protein, 386 aa, Gossypium hirsutum
  misc_feature (1)..(386): Ceres Clone ID no. 1829581
  misc_feature (1)..(386): Bit score of 335.2 for HMM based on sequences of Figure 4
  misc_feature (1)..(386): Functional Homolog Of SEQ ID NO. 111
  misc_feature (77)..(95): Pfam Name: IQ Pfam Description: IQ calmodulin-binding motif
MGKKGSWFTAVKKVLSLEPNKEEKIQKSKKNGVKLPEKIKGSKRDNWFAPATTMVTGALVRLTLSPHYLGKSMEEIATVKIQTVFRGYLARKALRDLRGLERLKSLIQGQSMKRQATITLRCMRTLARVQSQTRTRQLRVSEQNRALQKHLQTKYEKQLQNSKSYMGEDWNVSTKSKEQMQAKQQYRQVAAMRRERALAYSFTHQRSWKVTCRSMNHTSMDPFNPKWSWSWLERWMSTRPWEIQNAPDNNDHGPSKSVGAEITKAKSQSDVNNDHNKQSSTPAKPIRPPNRRSSSTPPSKTHSISSKKGLESPSPTRIQLPDCYKRHSIGGLSLERDDEVFANSPPNNKIPARSSSKDRSRPPSINRNPVNTRRHSGPPKVDIFSN

SEQ ID NO: 138 - protein, 468 aa, Medicago truncatula
  misc_feature (1)..(468): Public GI ID no. 357510601
  misc_feature (1)..(468): Bit score of 583.2 for HMM based on sequences of Figure 4
  misc_feature (1)..(468): Functional Homolog Of SEQ ID NO. 111
  misc_feature (110)..(128): Pfam Name: IQ Pfam Description: IQ calmodulin-binding motif
  misc_feature (359)..(448): Pfam Name: DUF4005 Pfam Description: Protein of unknown function (DUF4005)
MGKKGNWFSTVKKALSPDSKKSSKSKKKWFGKQKLQTSDPSVEIDTALPLPPPEDIKLTDIENQNNHHNVAEITTVVDVEEPVRSVQTAVVKTQAATVSRFAGKPKDEVAAIKIQTAFRGYLARRALRALRGLVRLKTLMEGPAVKRQAMSTLRSMQTLARVQSQIRSRRVRMLEENQALQRQLLQKHAKELETMRIGEEWDDSLQSKEQIEAKLLSKYEATMRRERALAYAFTHQQNSKNSSRSMNPMFVDPTNPTWGWSWIERWMAARPWESRGLVDKELNDHSSVKSSSRSIIGGEISKSFARFQLNSEIHSPVASQNPGSPSFQSNSTPTKPASASVARKLKKASPKGSWVMDDDSKSMASVQSDRFRRHSIAGSSVRDDESLASSPSVPSYMVPTQSAKARLRTQSQSPLAKENGKQEKGSFGTAKKRLSFPASPARPRRHSGPPKVETAINAELPVPNGVAS

SEQ ID NO: 139 - protein, 535 aa, Brachypodium distachyon
  misc_feature (1)..(535): Public GI ID no. 357129039
  misc_feature (1)..(535): Bit score of 300.3 for HMM based on sequences of Figure 4
  misc_feature (1)..(535): Functional Homolog Of SEQ ID NO. 111
  misc_feature (135)..(151): Pfam Name: IQ Pfam Description: IQ calmodulin-binding motif
MGRKGRWFDAVQRILTTSEPDRDEKESKKAERPANKSNFRKIWQFSKSSPSNPSSSAAPETALPPSQPDHQQEAEEIREAESAGTTSEQISDGRYLVAEPASATATAVAAQATEAVASVVAVTPRAPVSSKEELAIVRIQTACRGYLARRGHQARGQARLMELMEGITVRRQTEEALYCMQTMTRVQTQINSRRAKTEEGKKALKSQIQQKQSLDKAKIGEGWDHSHQSKEQLEALQATKQEAASRRQRAMSYAFSRQWRNRPRNPSASGRGATTPMHDPTFMDPGCPNWGWSIAERSMAAARPWENQSAPQGKDRAPAKSAAGVRTAKPRVSISIQIPPPTTPPGSRSARPPPGWPSPSTPTRPRSPSVLGRAPSPRGSALHRSTSGLSERPRSSQEHLGSGSSSPIQGGKEQQQGPLSLRRTTSLRSGELPRLSLGARPDVDTSEAGGAPVTPSYMQPTKSVRAKAGGGASPAAGDRAAEFPPEKAPPVSSPSVKKRLPMEFAKKASVPPASPRKLKAAERAKRPSQPPSPRL

SEQ ID NO: 140 - protein, 510 aa, Hordeum vulgare
  misc_feature (1)..(510): Public GI ID no. 326525172
  misc_feature (1)..(510): Hordeum vulgare subsp. vulgare
  misc_feature (1)..(510): Bit score of 253.0 for HMM based on sequences of Figure 4
  misc_feature (1)..(510): Functional Homolog Of SEQ ID NO. 111
  misc_feature (118)..(136): Pfam Name: IQ Pfam Description: IQ calmodulin-binding motif
  misc_feature (387)..(493): Pfam Name: DUF4005 Pfam Description: Protein of unknown function (DUF4005)
MGKKVRWFDAVQRILSTSGPDREDKEEKQPAERLTTRSSFKKLWHFGKSSTSTSTTPETAHQQPGQQEAVEVAGDKSVGTTSEQNDGGFHVAPVAQQPAEATAIVMPRAPARSKEELAAVRIQTACRGYLVRRGYQTRAQARLMSLLEGVAVKRQTEEALYSMQAMTRVQTQIYARRVKKEKDLKSQVQPKQGPDKTKIGEGWDPTHQSKEQIEATLATKQEAASRRQRALSYAFSHQWRNRSPSSSSSGRGRVTPTQSHPPTFMDPGCPNWGWSWAERWTAAARPWESQTATQDKDRPAPAKGAKPRVSISVHIPTTPTGRSPRPPGRQSPSTPTRPLSPSVMGKTVASPRRAPSPRGSPFNRSGSVLSERPRTSQEHPGASSGGGGDEKEASLRRTTSLWSGELPRSLSLGVRDVDADETGGAPVTPSYMQATKSVKAKARCASPAAADRAELPERAPLVSSPSMKKRPSLELAEKQGVSSPRTPRTPGTPGKAKAEIRAKRPPSPRF

SEQ ID NO: 141 - protein, 491 aa, Medicago truncatula
  misc_feature (1)..(491): Public GI ID no. 357443381
  misc_feature (1)..(491): Bit score of 465.0 for HMM based on sequences of Figure 4
  misc_feature (1)..(491): Functional Homolog Of SEQ ID NO. 111
  misc_feature (149)..(166): Pfam Name: IQ Pfam Description: IQ calmodulin-binding motif
MQRKLHMGRKGSWFSAVKKLFISDSKKDQKHLHKSNSKLTCFGHPQHHHHHHHHHYEDAEWKSGGVSPITVVPVPSLPPKEDVKPKKTDAENEQDKQAFSLILATAVATGAAVAAAKTAAQAAAEAALEAARITSLRPCYIGKTNEEIAAIKIQTAFRGYLARRTLRGLRGLARLKALVKGQSVQRQAATTLQCMQTLSRLQSQVSARKIRMSEENQSFQRQLQQKREKELDKLQAAPIGEKWDYSSQSKEQIQARLLNRQIAAMRREKALAYASTHQQTWRNSSKATDATIMDPNNPHWGWNWLDRWMASRPWEGQNTKDQKNHRSGKGVASHTMSVGEISKLYALRDQNQDDKKSPTSQKANNPNQASRVAVPSTSTRGKAKTSSSPRVGSWGGDGDSKFTFNKNSESNRRHSIAVAPVKEDESLVNTPAKFSKVKSNVQSPSVKKQLSFTASSSGSRRHSIPTKMGMNSNKNVAATIPEVKVKNGGSK

SEQ ID NO: 142 - protein, 403 aa, Physcomitrella patens
  misc_feature (1)..(403): Public GI ID no. 168063380
  misc_feature (1)..(403): Physcomitrella patens subsp. patens
  misc_feature (1)..(403): Bit score of 333.2 for HMM based on sequences of Figure 4
  misc_feature (1)..(403): Functional Homolog Of SEQ ID NO. 111
  misc_feature (10)..(28): Pfam Name: IQ Pfam Description: IQ calmodulin-binding motif
  misc_feature (263)..(368): Pfam Name: DUF4005 Pfam Description: Protein of unknown function (DUF4005)
SHIYSREDLAATRIQAAFRAYLARRALRALKGLVRLQALVRGHTVRRQATITLRCMQALVRVQARVRARRVRMSEEGQAVQRQLRERRQLECRPRRSTDGGWDDSTQTAEEIQAKLQSKQEAALKRERALAYGFSHQLWRADPNQTSQLYIDCEPDKPHWGWSWLERWMAARPWENRVFDTTSVSKDVFDSYSVKTMSDSYGNGHIHHSPSTMQRTSSQGNFHPPITPPSAYISTPVRVRSASPRTSVRREDIEEGGSTISATTARSMASGPRYGNRYSNAGSVMSRDDKSLASSPSVPNYMQATQSAKAKVRSHSTPKQRPRTPEKDNAWATKKRLSLPISENMVPTSGPIILRPFRPTPYAQRSPSLRNDQRSVSSLGNSSHQGDATPASSETSGLRPLYR

SEQ ID NO: 143 - protein, 449 aa, Eutrema halophilum
  misc_feature (1)..(449): Public GI ID no. 312282973
  misc_feature (1)..(449): Bit score of 357.1 for HMM based on sequences of Figure 4
  misc_feature (1)..(449): Functional Homolog Of SEQ ID NO. 111
  misc_feature (109)..(126): Pfam Name: IQ Pfam Description: IQ calmodulin-binding motif
MVKKAKWLKNVKKAFSPDLKKLKHQSVECQNSVISYPVLVATSRSSPPQFEVRVDEVNNEEKKKNLCPPPSDSVIATEEDVFVDSPPSSPEFVRPATPDRFAGKSKEEASAILIQSTFRGYLARRESREMRGLARLKLLMDGSVVQRQAANTLKCMQTLTRVQSQIRSRRVRMSEENQARHKQLLQKHAKELGGLKNGGNWNDSNQSKEQIEAGLLNKYEATMRRERALAYAFTHQQNLKSNSRSANPMFMDPSNPTWGWSWLERWMADRPWESSEKEQNNNSENSSVKTSSNRNSHRGETAKSSNRKNLNSSAQLNTPSSSSLSTTRIPRKNRPTPPSIKSKTTDENAKSSEKNRRHSIARSSVSDDENSTARRRNMVPTKSTRGKLKAQSSSSVSVITTTMEENGVLPQKAAAKKRISYSASPAPKPRRSSAPPKVENGLLKAVRTP

SEQ ID NO: 144 - protein, 500 aa, Oryza sativa
  misc_feature (1)..(500): Public GI ID no. 125550655
  misc_feature (1)..(500): Oryza sativa Indica Group
  misc_feature (1)..(500): Bit score of 465.0 for HMM based on sequences of Figure 4
  misc_feature (1)..(500): Functional Homolog Of SEQ ID NO. 111
  misc_feature (108)..(121): Pfam Name: IQ Pfam Description: IQ calmodulin-binding motif
  misc_feature (382)..(462): Pfam Name: DUF4005 Pfam Description: Protein of unknown function (DUF4005)
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQAAIKIQTAFRGYLLSENSSWLFISSAAFIYHCVGANITKARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMVPPSPMRRHSGPPKVEVVKDIAEPPQPEALVINGGSK

SEQ ID NO: 145 - protein, 461 aa, Arabidopsis thaliana
  misc_feature (1)..(461): Public GI ID no. 145357576
  misc_feature (1)..(461): Bit score of 481.8 for HMM based on sequences of Figure 4
  misc_feature (1)..(461): Functional Homolog Of SEQ ID NO. 111
  misc_feature (116)..(135): Pfam Name: IQ Pfam Description: IQ calmodulin-binding motif
  misc_feature (346)..(438): Pfam Name: DUF4005 Pfam Description: Protein of unknown function (DUF4005)
MGKKAKWFSSVKKAFSPDSKKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 146 - protein, 474 aa, Oryza sativa
  misc_feature (1)..(474): Public GI ID no. 125528277
  misc_feature (1)..(474): Oryza sativa Indica Group
  misc_feature (1)..(474): Bit score of 405.9 for HMM based on sequences of Figure 4
  misc_feature (1)..(474): Functional Homolog Of SEQ ID NO. 111
  misc_feature (144)..(162): Pfam Name: IQ Pfam Description: IQ calmodulin-binding motif
  misc_feature (348)..(452): Pfam Name: DUF4005 Pfam Description: Protein of unknown function (DUF4005)
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 147 - protein, 495 aa, Zea mays
  misc_feature (1)..(495): Public GI ID no. 224032591
  misc_feature (1)..(495): Bit score of 847.9 for HMM based on sequences of Figure 4
  misc_feature (1)..(495): Functional Homolog Of SEQ ID NO. 111
  misc_feature (136)..(154): Pfam Name: IQ Pfam Description: IQ calmodulin-binding motif
  misc_feature (368)..(476): Pfam Name: DUF4005 Pfam Description: Protein of unknown function (DUF4005)
MGKRGKWFSAVKKVFSSSDPDGKEAKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 148 - DNA, 1812 bp, Panicum virgatum
  misc_feature (1)..(1812): Ceres Clone ID no. 1747444
  misc_feature (1)..(1812): Encodes the peptide sequence at SEQ ID NO. 149
agaggtccgtgcggtgggcggtggcttaccagagttaggtccttggcgccttcagtcgggtgaggaaggcttgcagccgagacattgaagacacagtaatagaacacaaaagaatgggtaagaagggaaagtggtttagtgctgtgaagaaagtcttcggctcctccgatcctgatggaaagcaagcaaaggctgagaaggcggacaagtcaaaatccagtaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttaagaaaatgaagattgatgaagactgggatcacagccatcaatccaaagaacaaattgaggccagcctagttatgaaacaagaagctgcgctaagacgagaaagagcactcgcatatgctttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccgtccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcaaagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaagaagcgcctctccttcccagtcattgacaaaccgagcggtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtacc

SEQ ID NO: 149 - protein, 498 aa, Panicum virgatum
  misc_feature (1)..(498): Ceres Clone ID no. 1747444
  misc_feature (1)..(498): Bit score of 847.9 for HMM based on sequences of Figure 4
  misc_feature (1)..(498): Functional Homolog Of SEQ ID NO. 111
  misc_feature (141)..(159): Pfam Name: IQ Pfam Description: IQ calmodulin-binding motif
  misc_feature (372)..(479): Pfam Name: DUF4005 Pfam Description: Protein of unknown function (DUF4005)
MGKKGKWFSAVKKVFGSSDPDGKQAKAEKADKSKSSRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELKKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVKKRLSFPVIDKPSGPPADKPKERVRRHSDPPKVDPATLKDAPVA

SEQ ID NO: 150 - DNA, 2087 bp, Panicum virgatum
  misc_feature (1)..(2087): Ceres Clone ID no. 1998974
  misc_feature (1)..(2087): Encodes the peptide sequence at SEQ ID NO. 151
ggcaccgggagcgtgaccgtcacgagggggcgaagccccggggaagagccggagaggagatcgagagcggcccatcgcccccacaccacgccccacctccggctgcccgcctcccccgccgccgtggtccgcggctgcgggcggggccacgcgcccggctgggggtgaacagcgcgggacggggtcaccgtcgggcggtggggtgggcgaatcgatcctgcgtgcggggttgggctggccgataaaagggggcgcctttggactggcgaggcttgccgccgagacattgaagacacagtaatagaacacaaaaaatgggtaaaaagggaaagtggtttagtgctgtcaagaaagtcttcggctcctctgatccagatggaaaggaagcaaaggttgagaaggcggataagtcaaaatccaggaggagatggccatttggaaagtcgaggcactctgatccttctacctcaatggtgtcagggactgctccagtagctccgttgcctccgccaccaccaatacaacttactcagccacactcccaggagattaaagatgtcaagccagttgaaacagacagtgagcagaacaagcatgcatactctgttgcccttgcatccgctgttgctgctgaagctgctgcagttgctgcccaggccgctgctgaggttgtgcgcctcacagcagttaccacggcagcaccaaaaatgcctgttacttcaagggaagaacttgccgccatcaagattcagactgccttcaggggttatctggcaaggagagcattgcgggcactaagagggctagttagattgaagtcacttgtcgatggaaatgctgtcaagcgccaaacttctcacactttgcattgcacacaaacgatgacaagagttcaaactcaaatctactctagaagggtgaagttggaggaggaaaaacaagctcttcaaaggcagctccaattgaaacatcaaagggaacttgagaaaatgaagattgaagaagactgggatcacagccatcaatccaaagaacaaattgaggccagcctagttatgaaacaagaagctgcactaaaacgagaaagagcacttgcatatgcattttctcaccagtggagaaattctggtcgaactataaccccaactttcacagaacctgggaatcctaactggggctggagctggatggaacgctggatgacagcaagaccttgggagagccgattggcagcatcagacaaggataataaagagcgttctctgacaaagaattccagcagcagtgctgttcgaatgtctgtaccccgtgccatctcaatccagaggccagcaacaccaaacaagtcaagccgtccaccaagccggcagtcaccttcaacaccgccatcgaaggcaccatctacctcaggaaagaccaggccggcaagtccaaggggcagctggctgtacaaggaagatgacctgaggagcatcacaagcatacgctctgaacgcccaaggaggcaaagcataggcggaggctcggtccgggatgatgcaagcctgactagcacaccacctctccccagttatatgcagtcgacagagtctgcgagggcaaagtctcgataccgcagcttgttgactgaaaagcttgaggtttcagagagggcacctctggcccattcggttgttaagaagcgcctctccttccctgtcatcgacaaaccgagcagtccaccggcagataagacaaaggaaagagcgaggcgccattcagaccctccgaaggttgatcctgcaatgatgaaggatgcccctgttgcctgatcaggcccttgtgattgttaggtttcgtgctgttttaactccatgatgtattttctaagttagattgttttctctgcgtaatgtctaatctgtccgggttgatttgagaattgaggcaattctaactgtatttgctgtcatggttttctccctgtagattgatacgtgtgattctaatagtgtatgcccttggctttcaatgtacgatataacggtttttgacagactttcttaacgtgcgaaattgcaatatatatatatatatatatccattcc

SEQ ID NO: 151 - protein, 498 aa, Panicum virgatum
  misc_feature (1)..(498): Ceres Clone ID no. 1998974
  misc_feature (1)..(498): Bit score of 847.9 for HMM based on sequences of Figure 4
  misc_feature (1)..(498): Functional Homolog Of SEQ ID NO. 111
  misc_feature (141)..(159): Pfam Name: IQ Pfam Description: IQ calmodulin-binding motif
  misc_feature (372)..(476): Pfam Name: DUF4005 Pfam Description: Protein of unknown function (DUF4005)
MGKKGKWFSAVKKVFGSSDPDGKEAKVEKADKSKSRRRWPFGKSRHSDPSTSMVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGNAVKRQTSHTLHCTQTMTRVQTQIYSRRVKLEEEKQALQRQLQLKHQRELEKMKIEEDWDHSHQSKEQIEASLVMKQEAALKRERALAYAFSHQWRNSGRTITPTFTEPGNPNWGWSWMERWMTARPWESRLAASDKDNKERSLTKNSSSSAVRMSVPRAISIQRPATPNKSSRPPSRQSPSTPPSKAPSTSGKTRPASPRGSWLYKEDDLRSITSIRSERPRRQSIGGGSVRDDASLTSTPPLPSYMQSTESARAKSRYRSLLTEKLEVSERAPLAHSVVKKRLSFPVIDKPSSPPADKTKERARRHSDPPKVDPAMMKDAPVA

SEQ ID NO: 152 - DNA, 2233 bp, Panicum virgatum
  misc_feature (1)..(2233): Ceres Clone ID no. 1883040
  misc_feature (1)..(2233): Encodes the peptide sequence at SEQ ID NO. 153
gagaaaaaaggttgggctgcttgcccttcctttgctttttggtactttctttccgtctccggtttatttttccttcgtcctggatgcgctggtcgcgggtttgatctgaccaagacgtagaggcggtggtagaggtccgtggggtgggcggtggcttgctagagttaggtccttggcgcattcaggcgggtgaggaaggtgaggggctcagggctttcggtggttgcttgcttgcttgcttgctttgcctttctcgcggtaaaatcggatcttttggggttttgcgcgccgctatttgattcttcttggctggcttcgcctgcgcctttgttttggggttttgctgggttggtttcttcgcgattgtggtcgagggcggtgcggcgggtgcctcaggcacagctgcgagggtttctctgggtctggggcaacatccactcttcccgtttgtgattcgaccttctggcttgccgccgagacattgaagacacagtaatagaacacaaaaaatgggtaaaaagggaaagtggtttagtgctgtcaagaaagtcttcggctcctctgatccagatggaaaggaagcaaaggttgagaaggcggataagtcaaaatccaggaggagatggccatttggaaagtcgaggcactctgatccttctacctcaatggtgtcagggactgctccagtagctccgttgcctccgccaccaccaatacaacttactcagccacactcccaggagattaaagatgtcaagccagttgaaacagacagtgagcagaacaagcatgcatactctgttgcccttgcatccgctgttgctgctgaagctgatgcagttgctgcccaggccgctgctgaggttgtgcgcctcacagcagttaccacggcagcaccaaaaatgcctgtaacttcaagggaagaacttgccgccatcaagattcagactgccttcaggggttatctggcaaggagagcattgcgggcactaagagggctagttagattgaagtcacttgtcgatggaaatgctgtcaagcgccaaacttctcacactttgcattgcacacaaacgatgacaagagttcaaactcaaatctactctagaagggtgaagttggaggaggaaaaacaagctcttcaaaggcagctccaattgaaacatcaaagggaacttgagaaaatgaagattgaagaagactgggatcacagccatcaatccaaagaacaaattgaggccagcctagttatgaaacaagaagctgcactaaaacgagaaagagcacttgcatatgcattttctcaccagtggagaaattctggtcgaactataaccccaactttcacagaacctgggaatcctaactggggctggagctggatggaacgctggatgacagcaagaccttgggagagccgattggcagcatcagacaaggataataaagagcgttctctgacaaagaattccagcagcagtgctgttcgaatgtctgtaccccgtgccatctcaatccagaggccagcaacaccaaacaagtcaagccgtccaccaagccggcagtcaccttcaacaccgccatcgaaggcaccatctacctcaggaaagaccaggccagcaagtccaaggggcagctggctgtacaaggaagatgacctgaggagcatcacaagcatacgctctgaacgcccaaggaggcaaagcataggcggaggctcggtccgggatgatgcaagcctgactagcacaccacctctccccagttatatgcagtcgacagagtctgcgagggcaaagtctcgataccgcagcttgttgactgaaaagcttgaggtttcagagagggcacctctggcccattcggttgttaagaagcgcctctccttccctgtcatcgacaaaccgagcagtccaccggcagataagacaaaggaaagagcgaggcgccattcagaccctccgaaggttgatcctgcaatgctgaaggatgcccctgttgcctgatcaggcccttgtgattgttaggtttcgtgctgttttaactccatgatgtattttctatgttagattgttttctctgcgtaatgtctaatctgtccgggttgatttgagaattgaggcaattctaactgtatttgctgtcatggttttctccctgtagattgatacgtgtgattctaatagtgtatgcccttggctttcaatgtacgatataacggtttttgacagac

SEQ ID NO: 153 - protein, 498 aa, Panicum virgatum
  misc_feature (1)..(498): Ceres Clone ID no. 1883040
  misc_feature (1)..(498): Bit score of 845.5 for HMM based on sequences of Figure 4
  misc_feature (1)..(498): Functional Homolog Of SEQ ID NO. 111
  misc_feature (141)..(159): Pfam Name: IQ Pfam Description: IQ calmodulin-binding motif
  misc_feature (372)..(476): Pfam Name: DUF4005 Pfam Description: Protein of unknown function (DUF4005)
MGKKGKWFSAVKKVFGSSDPDGKEAKVEKADKSKSRRRWPFGKSRHSDPSTSMVSGTAPVAPLPPPPPIQLTQPHSQEIKDVKPVETDSEQNKHAYSVALASAVAAEADAVAAQAAAEVVRLTAVTTAAPKMPVTSREELAAIKIQTAFRGYLARRALRALRGLVRLKSLVDGNAVKRQTSHTLHCTQTMTRVQTQIYSRRVKLEEEKQALQRQLQLKHQRELEKMKIEEDWDHSHQSKEQIEASLVMKQEAALKRERALAYAFSHQWRNSGRTITPTFTEPGNPNWGWSWMERWMTARPWESRLAASDKDNKERSLTKNSSSSAVRMSVPRAISIQRPATPNKSSRPPSRQSPSTPPSKAPSTSGKTRPASPRGSWLYKEDDLRSITSIRSERPRRQSIGGGSVRDDASLTSTPPLPSYMQSTESARAKSRYRSLLTEKLEVSERAPLAHSVVKKRLSFPVIDKPSSPPADKTKERARRHSDPPKVDPAMLKDAPVA

SEQ ID NO: 154 - protein, 499 aa, Hordeum vulgare
  misc_feature (1)..(499): Public GI ID no. 326520123
  misc_feature (1)..(499): Hordeum vulgare subsp. vulgare
  misc_feature (1)..(499): Bit score of 817.9 for HMM based on sequences of Figure 4
  misc_feature (1)..(499): Functional Homolog Of SEQ ID NO. 111
  misc_feature (144)..(162): Pfam Name: IQ Pfam Description: IQ calmodulin-binding motif
  misc_feature (388)..(476): Pfam Name: DUF4005 Pfam Description: Protein of unknown function (DUF4005)
MAKKGKWFSAVRRVFSSSDPEGKEAKTEKADKPKSRRKWPFGKSKRFDPPTSTVSDITPVAPSPLPLPLPPTQPPQPQPEEIKDVKPVETESEQNKHAYSVALASAVAAEAAAVAAQAAAEVVRLTAVPTATSRAPVCSQEELAAVKIQTAFRGYLARRALRALRGLVRLKSLVDGNAVKRQTAHTLHCTQTMARVQTQIYSRRVKMEEEKQALQRQLQLKHQRELEKMKIDEDWDHSHQSKEQIEASLIMKQEAAVRRERALAYAFSHQWKNSGRTVTPTFTDQGNPNWGWSWMERWMSARPWENRVVSNKDKDTALTKNPSTNAARTFVPRALSIQRPATPSKSSRPPSRQSPSTPPSKNPSVAGKFRPSSPRDSWLYREDDLRSITNIRSERPRRLSTGGGSIQDDASLTSTPALPSYMQSTKSARAKSRYHMVFADKFEVPDRASLVHSSIKKRLSFPAAEKPNVTPADKLKERARRHSDPPKVEPASLKDVHVA

SEQ ID NO: 155 - protein, 308 aa, Oryza sativa
  misc_feature (1)..(308): Public GI ID no. 215701453
  misc_feature (1)..(308): Oryza sativa Japonica Group
  misc_feature (1)..(308): Bit score of 535.2 for HMM based on sequences of Figure 4
  misc_feature (1)..(308): Functional Homolog Of SEQ ID NO. 111
  misc_feature (182)..(286): Pfam Name: DUF4005 Pfam Description: Protein of unknown function (DUF4005)
MTRVQTQIYSRRVKMEEEKQALQRQLQLKHQRELEKMKIDEDWDHSHQSKEQVETSLMMKQEAALRRERALAYAFSHQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 156 - protein, 482 aa, Vitis vinifera
  misc_feature (1)..(482): Public GI ID no. 147809623
  misc_feature (1)..(482): Bit score of 821.2 for HMM based on sequences of Figure 4
  misc_feature (1)..(482): Functional Homolog Of SEQ ID NO. 111
  misc_feature (119)..(137): Pfam Name: IQ Pfam Description: IQ calmodulin-binding motif
  misc_feature (372)..(467): Pfam Name: DUF4005 Pfam Description: Protein of unknown function (DUF4005)
MGKKGNWFSAVKKALSPEPKEKKDKTTPKSKKKWFGKHKNLDPVSSSTENAMPLPAPAPPIEDVKLTEAENEQSKHAYSVALATAVAAEAAVAAAHAAAEVVRLTTVTRFSGKSKEEVAAIKIQTAFRGYLARRALRALRGLVRLKSLIQGQSVKRQATTTLRCMQTLARVQSQIRARRIRMSEENLALQRQLQLKRDKELEKLRASIGDDWDDSVQSKEQIEANLQSKQEAAVRRERALAYAFSHQQTWKNSSKPANPTFMDPNNPHWGWSWLERWMAARPWESRSAMEKELNTDHASLKSTTSRAFSIGEISKAYARRDLNLDKKPSPTAQKPSRPPSRQSPSTPPSKAQSSSSVTGKTRPASPKGSGWGADDDSRSMLSIQSEWYRRHSIAGSLVRDDESLASSPAVPSYMASTESTRARSRLPSPLGLEKNGTPEKASGSSAKKRLSFPASPAGPRRHSGPPRVETSSIKAISPAHRG

SEQ ID NO: 157 - protein, 443 aa, Populus trichocarpa
  misc_feature (1)..(443): Public GI ID no. 224109704
  misc_feature (1)..(443): Bit score of 727.1 for HMM based on sequences of Figure 4
  misc_feature (1)..(443): Functional Homolog Of SEQ ID NO. 111
  misc_feature (113)..(131): Pfam Name: IQ Pfam Description: IQ calmodulin-binding motif
  misc_feature (343)..(435): Pfam Name: DUF4005 Pfam Description: Protein of unknown function (DUF4005)
MGKRGSWFSALKKALGSSKKKWSEKEKNRDLGVSSHEETVAPSLSPPRTPPPPTAEDVKLTEAENEQSKHAYSVALATAVAAEAAVAAAQAAAEVVRLTTVAHYSGKSKEEIAAIRIQTAFRGYLARRALRALRGLVRLKSLIQGQSVKRQATATLRAMQTLARVQSQIRARRIRMSEENEALQRQLQQKHDKELEKLRTSVKQWDDSPQSKEEVEASLLQKQEAAMRRERALAYAYSHQQMWKQSSKSANATFMDPNNPRWGWSWLERWMAARPWESRSTIDNNDRASVKSTTSPSPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAV

SEQ ID NO: 158 - protein, 479 aa, Vitis vinifera
  misc_feature (1)..(479): Public GI ID no. 225439898
  misc_feature (1)..(479): Bit score of 669.8 for HMM based on sequences of Figure 4
  misc_feature (1)..(479): Functional Homolog Of SEQ ID NO. 111
  misc_feature (113)..(132): Pfam Name: IQ Pfam Description: IQ calmodulin-binding motif
  misc_feature (358)..(460): Pfam Name: DUF4005 Pfam Description: Protein of unknown function (DUF4005)
MGRKGNWLSSVKKALSPEPKEKKDQRADKSKKKWFGKHKYPDPNPSSLETVPGPSLAPPEEVKTIEPDNEHHKHVYSVAATTTMASLDVPETDVEVVEITTLTQSTGKAKEEAAAIKIQTAFRGYLARRALRALRGLVRLQSLIQGTAVKRQAANTLRCMQTLARVQSQICYRRIRMSEENQALQRQLLQKQAKEFEQLKMGEEWDDSLQSKEQIEAGLLNKQGAAMRRERALAYAFSHQQAWKNSSKSTNLLFMDPSNPHWGWSWLERWMAARPWESRSTTDKELNNDQLSIKSGSRSITGGEITKAYARHLLDSSKPSPTASQKPYHPPARQSPSTPPSKAVSSSSAAGKFKPAASPRGNLWGQDDDTKSMVSIQSERFRRHSIAGSSVGDDESLASSPAVPSYMAPTKSAKAKSRLQSPLGLENNGTPEKGSSGIAKKRLSFPASPARPRRHSGPPRVESSSLTEGIVSNGGGTVS

SEQ ID NO: 159 - protein, 474 aa, Oryza sativa
  misc_feature (1)..(474): Public GI ID no. 218196002
  misc_feature (1)..(474): Oryza sativa Indica Group
  misc_feature (1)..(474): Bit score of 564.1 for HMM based on sequences of Figure 4
  misc_feature (1)..(474): Functional Homolog Of SEQ ID NO. 111
  misc_feature (108)..(127): Pfam Name: IQ Pfam Description: IQ calmodulin-binding motif
  misc_feature (356)..(436): Pfam Name: DUF4005 Pfam Description: Protein of unknown function (DUF4005)
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQAAIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMVPPSPMRRHSGPPKVEVVKDIAEPPQPEALVINGGSK

SEQ ID NO: 160 - protein, 474 aa, Oryza sativa
  misc_feature (1)..(474): Public GI ID no. 54306075
  misc_feature (1)..(474): Oryza sativa Japonica Group
  misc_feature (1)..(474): Bit score of 561.4 for HMM based on sequences of Figure 4
  misc_feature (1)..(474): Functional Homolog Of SEQ ID NO. 111
  misc_feature (108)..(127): Pfam Name: IQ Pfam Description: IQ calmodulin-binding motif
  misc_feature (356)..(442): Pfam Name: DUF4005 Pfam Description: Protein of unknown function (DUF4005)
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 161 - DNA, 1440 bp, Populus trichocarpa
  misc_feature (1)..(1440): Ceres Annot ID no. 1484880
  misc_feature (1)..(1440): Encodes the peptide sequence at SEQ ID NO. 162
atggggaggaaaggaaaatggttttctagtgtaaagaaagctcttagccctgattccaaggagaagaaagaccagaaatcaaataaatcgaagaagaaatggtttggcaagcaacaactggattcggattccacttctttagaaaatgttacaatgcgatctcctcctcctcctcaaccagacgaggtgaaattaattgaaaccacaaatgaagagaaccagcatacttactctgttccagttgtcactgctgcagtagctgagcatgctccgattactgttcaaaccaccactgaggtttttcaaccaaccaaggttaataaatatgctggcaaatcaaaggaagaagtggcggcaattaagattcagacagcattccgaggatacatggcaagaagagcattgcgggctctgagagggctgttcaggctcaaatctctgatggaagggcctacgataaaaagacaagcaacccatactctccactgcatgcagactctagctcgggtgcagtcacagatacacacaaggaggattagaatgtcagaagagaaccaggccctacagagacaactcctacatgagcatgcaaaagagtttgaaagcttgcagattggagaggaatgggatgacagtctacagtcaaaggaacagattgaagctaacctgctaaacaagtttgaggcagctgtgagaagggaaagagcactggcttattctttctctcatcagcaagcctggaaaatttcttcacgagctgtaaacccaatgttcatgagtggcaatccatcctggggttggagctggttggaacgatggatggcagcccatccatgggagagccggagcatgacggagaaagaacttaataatgaccactcatctctaaagagtgcgagccgcagcattactggaggggatataagcaaatcttatgctcgctaccagctcaattctgataaactaactccaagagaaagtgaaaggccaaccaaaaccgcgaacctacagttccaatcaactcctaacaagccagctgcttctacagttgctagaaaattgaagtcagccagcccaaggagtggcattgggggcctagatgatgaatctaaaagtgtggtcagtgttcagtcagatcatagtagaaggcatagcattgcaggttcatttgtacgagatgatgagagccttggaagctctccaccacttccaagttacatggtacctacagaatccgcgagagcaaagtccagattacaaaacccattgggggcagagatgaacggagcgcctgaaaaggaaaagggatccttggggtctgccaagaagcggctttcctaccctccctcaccagccaaagcaaggaggtattcaggtcccccgaaattggaaagcagcttaaaagcagaaaacagtgaggctgctggcgagggcatttaa

SEQ ID NO: 162 - protein, 479 aa, Populus trichocarpa
  misc_feature (1)..(479): Ceres Annot ID no. 1484880
  misc_feature (1)..(479): Bit score of 607.4 for HMM based on sequences of Figure 4
  misc_feature (1)..(479): Functional Homolog Of SEQ ID NO. 111
  misc_feature (118)..(136): Pfam Name: IQ Pfam Description: IQ calmodulin-binding motif
  misc_feature (368)..(459): Pfam Name: DUF4005 Pfam Description: Protein of unknown function (DUF4005)
MGRKGKWFSSVKKALSPDSKEKKDQKSNKSKKKWFGKQQLDSDSTSLENVTMRSPPPPQPDEVKLIETTNEENQHTYSVPVVTAAVAEHAPITVQTTTEVFQPTKVNKYAGKSKEEVAAIKIQTAFRGYMARRALRALRGLFRLKSLMEGPTIKRQATHTLHCMQTLARVQSQIHTRRIRMSEENQALQRQLLHEHAKEFESLQIGEEWDDSLQSKEQIEANLLNKFEAAVRRERALAYSFSHQQAWKISSRAVNPMFMSGNPSWGWSWLERWMAAHPWESRSMTEKELNNDHSSLKSASRSITGGDISKSYARYQLNSDKLTPRESERPTKTANLQFQSTPNKPAASTVARKLKSASPRSGIGGLDDESKSVVSVQSDHSRRHSIAGSFVRDDESLGSSPPLPSYMVPTESARAKSRLQNPLGAEMNGAPEKEKGSLGSAKKRLSYPPSPAKARRYSGPPKLESSLKAENSEAAGEGI

SEQ ID NO: 163 - protein, 467 aa, Zea mays
  misc_feature (1)..(467): Public GI ID no. 224028605
  misc_feature (1)..(467): Bit score of 543.3 for HMM based on sequences of Figure 4
  misc_feature (1)..(467): Functional Homolog Of SEQ ID NO. 111
  misc_feature (108)..(126): Pfam Name: IQ Pfam Description: IQ calmodulin-binding motif
  misc_feature (352)..(441): Pfam Name: DUF4005 Pfam Description: Protein of unknown function (DUF4005)
MGKKGKWFGAVKKVFSPESKEKKEERLRRKSAASNPTPVDLTPSTSLEVNLSVPPPPAPPPVLHQAEEVGVPEAEQEQSKHVAVEEAPAAAPAQASVLPPAVPTQELAAVKIQTAFRGYLARRALRALRGLVRLKSLVEGNSVKRQSASTLRCMQTLSRVQSQISSRRAKMSEENQALQRQLLLKQELENFRIGENWDDSTQSKEQIEASLISRQEAAIRRERALAYAFSHQWKSTSRSVNPMFVDPNNLQWGWSWLERWMAAKPWEGRNGADKESNIDRGSVKSMSLNLGEGEITKAFNRRDSKLEKPSPPTPRPARPTSRHSPLTPSARVAPIPARRKFVTPKNGLSQVDDDARSVLSVQSERPRRHSIATSTVRDDESLTSSPSLPSYMVPTESARAKSRLQGSATANGAETPEKGGSTGPAKKRLSFQGGTVSASPMRRHSGPPKVEIAPPQPEALVVNGGSK

SEQ ID NO: 164 - DNA, 1437 bp, Populus trichocarpa
  misc_feature (1)..(1437): Ceres Annot ID no. 1528800
  misc_feature (1)..(1437): Encodes the peptide sequence at SEQ ID NO. 165
atggggaggaaaggaaaatggttttctagtgtaaagaaagctcttagccctgatcccaaggagaagacagaccagaaatcaaataaatcaaagaagaaatggtttggaaagcaacaactggattcggattccacttctttagaaaatgtcacaatgctgtctcctcctccccaaccagaagaagtgaaattaattgagacaacagatgaagtgaaccagcatactttccctgttccagttgccactgctgcagtacctgagcctgctccgactactgtccaaaccaatattgaggttgttcaactgaccaaggtaaacaaatatgctggcaaatcaaaggaagaagaggcggcaattaagattcaaacaacattcagaggatacatggccagaagagcattgcgggctctgagagggttggcgaggctcaaatttctgatggaagggcctagaataaaaaggcaagcaacacataccctccgctgcatgcagactctagctcgggtgcagtcacagattcacacaaggaggatcagaatgtcagaagagaaccaggccctacagagacaactcctacagaagcatgccaaagagcttgaaaacttgcggattggagaggaatgggatgacagtctacagtcgaaggaacagattgaagctagcctgctaaacaagtttgaggccgctacgagaagggaaagagcactggcttatgctttctctcatcagcaaactttgaagaattcttcacgatctgcaaaccccatgttcatgaatgggaatccttcctggggttggagctggttggaacgatggatggcagcccatccatgggagagccggagcttgatggagaaagaacacaataacgaccactcatctgtaaagagtgccagccgcagcattactggaggagaaataagcaaatcttatgctcgctaccagctcaattctgataaattaactccaagagaaagtgaaaggccaaccaaaaccacgaacctacagtccccatcaactcctaaaaagccagctgcttctacagttgctagaaaattgaagtcagcaagcccaaggagtaacattgggggcattgaagatgactctagaagcatggtcagtgttcaatcagatcgtagtagaaggcatagcattgctggttcatttgtgcgagatgatgagagcctcggaagctctccagcgcttccaagttacatggtacctacacaatctgcaagagcaaagtccagaatacatagcctattgggagcagaaaaggacgggacaccagaaaaggaaaagggttcctctgggcatacaaagaaacggctttcataccctccatcgccagccaaaggaaggaggtattctggccccccaaagttggaaagcagcttcaatgcaagaaatagcgtggctgctggcgagggaatttaa

SEQ ID NO: 165 - protein, 478 aa, Populus trichocarpa
  misc_feature (1)..(478): Ceres Annot ID no. 1528800
  misc_feature (1)..(478): Bit score of 612.4 for HMM based on sequences of Figure 4
  misc_feature (1)..(478): Functional Homolog Of SEQ ID NO. 111
  misc_feature (116)..(135): Pfam Name: IQ Pfam Description: IQ calmodulin-binding motif
  misc_feature (357)..(460): Pfam Name: DUF4005 Pfam Description: Protein of unknown function (DUF4005)
MGRKGKWFSSVKKALSPDPKEKTDQKSNKSKKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 166 - DNA, 2001 bp, Panicum virgatum
  misc_feature (1)..(2001): Ceres Clone ID no. 1792902
  misc_feature (1)..(2001): Encodes the peptide sequence at SEQ ID NO. 167
gtcactctcggcactgctcccagctgttgcgacctccgaacatccaaggctcctgcacccctgtcagtcctagctccagccaaaaatcgttggctcccgctgcctgctcctccgccttgcacctcccatgaccttccacgcgacatgattgcattgcaggcccctgcggagctcagctgtcctcccacgccgctgacgccttcttgttgcctccacgctgctgcgctcaaccgaaagggccttcctctctttgcttccgcggaaggatttggcgatttattcatctactaaagttgcatctctcttgtgcgtggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattaaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtggggctggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcaacgccctccgctaaagtagcgccaatacctgtgaggagaaaatccgtcacgccaaagaatgggctttcacatgtggatgacgatgcgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgt

SEQ ID NO: 167 - protein, 471 aa, Panicum virgatum
  misc_feature (1)..(471): Ceres Clone ID no. 1792902
  misc_feature (1)..(471): Bit score of 547.7 for HMM based on sequences of Figure 4
  misc_feature (1)..(471): Functional Homolog Of SEQ ID NO. 111
  misc_feature (106)..(124): Pfam Name: IQ Pfam Description: IQ calmodulin-binding motif
  misc_feature (355)..(441): Pfam Name: DUF4005 Pfam Description: Protein of unknown function (DUF4005)
MGKKGKWFGAVKKVFSPESKEKKEERQRRKSAASNPTPLDLTPSTSLEVNVSVPPPPAPPALHQIKEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDARSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 168 - DNA, 2117 bp, Panicum virgatum
  misc_feature (1)..(2117): Ceres Clone ID no. 1806867
  misc_feature (1)..(2117): Encodes the peptide sequence at SEQ ID NO. 169
gtcactctcgccactgctcccagctgttgcgacttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttgtgcgtgtttgccaccgtggtcttgttatcatcgtccaacgttgggtcgtctgatagatatagatctgggccatctggtgatttgcttgttcctcttcagggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactgacccgtccagcctccaggcaatccccttcgacgccctctgctaaagtagcgccaatacctgctaggagaaaatccgccacgccaaagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccggagaaaggaagctctgctggaccggtcaagaaaaggttgtcatttcaaggtggaacagcggctgcctcaccaatgcgacggcattctggtcctcccaaggtggacagtgtgatgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttccg

SEQ ID NO: 169 - protein, 471 aa, Panicum virgatum
  misc_feature (1)..(471): Ceres Clone ID no. 1806867
  misc_feature (1)..(471): Bit score of 544.3 for HMM based on sequences of Figure 4
  misc_feature (1)..(471): Functional Homolog Of SEQ ID NO. 111
  misc_feature (106)..(124): Pfam Name: IQ Pfam Description: IQ calmodulin-binding motif
  misc_feature (357)..(442): Pfam Name: DUF4005 Pfam Description: Protein of unknown function (DUF4005)
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPKNGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSVMKDIVAPPQPEALVINGGSK

SEQ ID NO: 170 - DNA, 2024 bp, Panicum virgatum
  misc_feature (1)..(2024): Ceres Clone ID no. 1727738
  misc_feature (1)..(2024): Encodes the peptide sequence at SEQ ID NO. 171
gttctctctccctcgtcactctcgccactgctcccagctgttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactaacccgtccagcctccaggcaatccccttcgacgccctctgctaaagtagcgccaatacctgctaggagaaaatccgccacgccagagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccagagaaaggaagctctgctggaccggtcaagaaaaggttgtcatttcaaggtggaacagcggctgcctcaccaatgcgacggcattctggtcctcccaaggtggacagtgcggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttctg

SEQ ID NO: 171 - protein, 471 aa, Panicum virgatum
  misc_feature (1)..(471): Ceres Clone ID no. 1727738
  misc_feature (1)..(471): Bit score of 543.7 for HMM based on sequences of Figure 4
  misc_feature (1)..(471): Functional Homolog Of SEQ ID NO. 111
  misc_feature (106)..(124): Pfam Name: IQ Pfam Description: IQ calmodulin-binding motif
  misc_feature (357)..(442): Pfam Name: DUF4005 Pfam Description: Protein of unknown function (DUF4005)
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPENGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSAVKDIVAPPQPEALVINGGSK

SEQ ID NO: 172 - protein, 467 aa, Zea mays; identical to SEQ ID NO: 128
  misc_feature (1)..(467): Public GI ID no. 238007500
  misc_feature (1)..(467): Bit score of 542.7 for HMM based on sequences of Figure 4
  misc_feature (1)..(467): Functional Homolog Of SEQ ID NO. 111
  misc_feature (108)..(126): Pfam Name: IQ Pfam Description: IQ calmodulin-binding motif
  misc_feature (352)..(441): Pfam Name: DUF4005 Pfam Description: Protein of unknown function (DUF4005)

SEQ ID NO: 173 - DNA, 1422 bp, Sorghum bicolor
  misc_feature (1)..(1422): Ceres Annot ID no. 8724651
  misc_feature (1)..(1422): Encodes the peptide sequence at SEQ ID NO. 174
atggggaagaagggcaagtggttcggcgccgtcaagaaggtcttcagccctgaatccaaggagaagaaagaggagagactaaggaggaaatcagcagctagcaacccagcaccgctagatctgaccccatctacctccttggaagtcaatgtttcggtgccaccccctccagctccggcacctcctccagttctccaccaggccgaggaggtcagggtccctgaacccgagcaggagcagagcaagcatgtcaccgtggaggagccccctgctgttccagcacagccgtcggtgctgccacctggtgtgccaaccgaagagcttgctgcggtcaagatccagaccgccttccgaggttacctggcaaggagggcactaagagcactgcgaggtcttgttcgattgaagtcattggttgagggtaattcagtcaagcgtcaatctgcaagcactctgcgctgtatgcaaactctatcgcgggtgcagtcacaaatacgttctaggagagcaaagatgtccgaggagaaccaggccctccaacgccagctcctacttaaacaggaattggagaatttcagaatgggtgagaactgggatgacagcactcaatccaaggagcaaatcgaggcaagcctgataagcaggcaagaagcagcgataagaagagaaagagcgcttgcatatgcattttcacatcagtggaagagtacttcaagatctgtcaacccaatgtttgtagacccaaacaacttgcagtggggctggagctggttggagcgctggatggcagcaaaaccttgggagggccgtaatggggctgacaaggagagcaactttgaccgcggatcagttaagagtatgagcttgaaccttggagagggtgaaatcacaaaagctttcaaccgccgggactcaaagccagaaaagccatcaccaccaactccaaaaccaacccgtccagcctggcaatccccttcgacgccatctgctaaagtggcaccaatacctgccaggaggaaatccgccacgccaaagaatgggctttcacaggtggacgatgacgctaggagtgtgctcagcgtgcagtctgagcgaccaaggaggcacagtatagccacctcgactgtgcgggatgatgaaagcctcgcaagctccccatcactccccagctacatggttcccacggaatctgcaagagccaaatctcgtctccagggctcatcaatgaccaatggtgcagagacaccagagaaaggaggctctactggaccagtcaagaagaggttgtccttccaaggtggaactgcagctgcctcaccaatgcggcggcattctggtcctcccaaggtggagagtgcagtgaaggacattgttgcaccaccacagccagaggccttggtagtcaatggtggaagcaagtga

SEQ ID NO: 174 - protein, 473 aa, Sorghum bicolor
  misc_feature (1)..(473): Ceres Annot ID no. 8724651
  misc_feature (1)..(473): Bit score of 529.8 for HMM based on sequences of Figure 4
  misc_feature (1)..(473): Functional Homolog Of SEQ ID NO. 111
  misc_feature (109)..(127): Pfam Name: IQ Pfam Description: IQ calmodulin-binding motif
  misc_feature (349)..(444): Pfam Name: DUF4005 Pfam Description: Protein of unknown function (DUF4005)
MGKKGKWFGAVKKVFSPESKEKKEERLRRKSAASNPAPLDLTPSTSLEVNVSVPPPPAPAPPPVLHQAEEVRVPEPEQEQSKHVTVEEPPAVPAQPSVLPPGVPTEELAAVKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNFDRGSVKSMSLNLGEGEITKAFNRRDSKPEKPSPPTPKPTRPAWQSPSTPSAKVAPIPARRKSATPKNGLSQVDDDARSVLSVQSERPRRHSIATSTVRDDESLASSPSLPSYMVPTESARAKSRLQGSSMTNGAETPEKGGSTGPVKKRLSFQGGTAAASPMRRHSGPPKVESAVKDIVAPPQPEALVVNGGSK

SEQ ID NO: 175 - DNA, 1836 bp, Panicum virgatum
  misc_feature (1)..(1836): Ceres Clone ID no. 1897134
  misc_feature (1)..(1836): Encodes the peptide sequence at SEQ ID NO. 176
atctgctgtctccaagctgtcccaagtcctctttcccctgacccctctaaaatctccccagcgacagcgagagagagagagagaggagggaggacgagcgcattcgcatcgtggcaacaggcaccaagggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattgaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtgggactggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcgacgccctccgctaaagtagcgccaatacctgtgaggagaaaatccgtcacgccaaagaatgggctttcacatgtggatgacgatgtgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgtgagccatatatttcttctc

SEQ ID NO: 176 - protein, 471 aa, Panicum virgatum
  misc_feature (1)..(471): Ceres Clone ID no. 1897134
  misc_feature (1)..(471): Bit score of 543.8 for HMM based on sequences of Figure 4
  misc_feature (1)..(471): Functional Homolog Of SEQ ID NO. 111
  misc_feature (106)..(124): Pfam Name: IQ Pfam Description: IQ calmodulin-binding motif
  misc_feature (356)..(441): Pfam Name: DUF4005 Pfam Description: Protein of unknown function (DUF4005)
MGKKGKWFGAVKKVFSPESKEKKEERQRRKSAASNPTPLDLTPSTSLEVNVSVPPPPAPPALHQIEEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWDWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDVRSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 177 - DNA, 2015 bp, Panicum virgatum
  misc_feature (1)..(2015): Ceres Clone ID no. 1859266
  misc_feature (1)..(2015): Encodes the peptide sequence at SEQ ID NO. 178
tcactctcgccactgctcccagctgttgcgacttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtgaagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttgaagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactgacccgtccagcctccaggcaatccccttcgacgccctctgctaaagtagcgccaatacctgctaggagaaaatccgccacgccaaagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaggggcgaagtctcgtctccagggatcagcattgactaatggtgcagagacaccggagaaaggaagctctgctggaccggtcaagaaaaggttgtcatttcaaggtggaacagcggctgcctcaccaatgcgacggcattctggtcctcccaaggtggacagtgtggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttct

SEQ ID NO: 178 - protein, 471 aa, Panicum virgatum
  misc_feature (1)..(471): Ceres Clone ID no. 1859266
  misc_feature (1)..(471): Bit score of 539.1 for HMM based on sequences of Figure 4
  misc_feature (1)..(471): Functional Homolog Of SEQ ID NO. 111
  misc_feature (106)..(124): Pfam Name: IQ Pfam Description: IQ calmodulin-binding motif
  misc_feature (357)..(441): Pfam Name: DUF4005 Pfam Description: Protein of unknown function (DUF4005)
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLKRWMAAKPWEGCNGADKESNIDRGSVKSMSLNLGEGEITKAFNRRDSKPEKPSPPTPKLTRPASRQSPSTPSAKVAPIPARRKSATPKNGLSHVDDDARSVFSVQSERPRRHSIATSTVQDNESLASSPSLPSYMVPTESAGAKSRLQGSALTNGAETPEKGSSAGPVKKRLSFQGGTAAASPMRRHSGPPKVDSVVKDIVAPPQPEALVINGGSK

SEQ ID NO: 179 - protein, 476 aa, Zea mays
  misc_feature (1)..(476): Public GI ID no. 194696788
  misc_feature (1)..(476): Bit score of 552.2 for HMM based on sequences of Figure 4
  misc_feature (1)..(476): Functional Homolog Of SEQ ID NO. 111
  misc_feature (110)..(128): Pfam Name: IQ Pfam Description: IQ calmodulin-binding motif
  misc_feature (361)..(446): Pfam Name: DUF4005 Pfam Description: Protein of unknown function (DUF4005)
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQAPVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 180 - DNA, 1455 bp, Populus trichocarpa
  misc_feature (1)..(1455): Ceres Annot ID no. 1475350
  misc_feature (1)..(1455): Encodes the peptide sequence at SEQ ID NO. 181
atggggaggaaaggaaaatggttttctagtgtaaagaaagctcttagccctgatcccaaggagaagacagaccagaaatcaaataaatcaaagaagaaatggtttggaaagcaacaactggattcggattccacttctttagaaaatgtcacaatgctgtctcctcctccccaaccagaagaagtgaaattaattgagacaacagatgaagtgaaccagcatactttccctgttccagttgccactgctgcagtacctgagcctgctccgactactgtccaaaccaatattgaggttgttcaactgaccaaggtaaacaaatatgctggcaaatcaaaggaagaagaggcggcaattaagattcaaacaacattcagaggatacatggccagaagagcattgcgggctctgagagggttggcgaggctcaaatttctgatggaagggcctagaataaaaaggcaagcaacacataccctccgctgcatgcagactctagctcgggtgcagtcacagattcacacaaggaggatcagaatgtcagaagagaaccaggccctacagagacaactcctacagaagcatgccaaagagcttgaaaacttgcggggcatgcaatgttttcatattggagaggaatgggatgacagtctacagtcgaaggaacagattgaagctagcctgctaaacaagtttgaggccgctacgagaagggaaagagcactggcttatgctttctctcatcagcaaactttgaagaattcttcacgatctgcaaaccccatgttcatgaatgggaatccttcctggggttggagctggttggaacgatggatggcagcccatccatgggagagccggagcttgatggagaaagaacacaataacgaccactcatctgtaaagagtgccagccgcagcattactggaggagaaataagcaaatcttatgctcgctaccagctcaattctgataaattaactccaagagaaagtgaaaggccaaccaaaaccacgaacctacagtccccatcaactcctaaaaagccagctgcttctacagttgctagaaaattgaagtcagcaagcccaaggagtaacattgggggcattgaagatgactctagaagcatggtcagtgttcaatcagatcgtagtagaaggcatagcattgctggttcatttgtgcgagatgatgagagcctcggaagctctccagcgcttccaagttacatggtacctacacaatctgcaagagcaaagtccagaatacatagcctattgggagcagaaaaggacgggacaccagaaaaggaaaagggttcctctgggcatacaaagaaacggctttcataccctccatcgccagccaaaggaaggaggtattctggccccccaaagttggaaagcagcttcaatgcaagaaatagcgtggctgctggcgagggaatttaa

SEQ ID NO: 181 - protein, 484 aa, Populus trichocarpa
  misc_feature (1)..(484): Ceres Annot ID no. 1475350
  misc_feature (1)..(484): Bit score of 606.1 for HMM based on sequences of Figure 4
  misc_feature (1)..(484): Functional Homolog Of SEQ ID NO. 111
  misc_feature (116)..(135): Pfam Name: IQ Pfam Description: IQ calmodulin-binding motif
  misc_feature (363)..(466): Pfam Name: DUF4005 Pfam Description: Protein of unknown function (DUF4005)
MGRKGKWFSSVKKALSPDPKEKTDQKSNKSKKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRGMQCFHIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 182 - protein, 484 aa, Hordeum vulgare
  misc_feature (1)..(484): Public GI ID no. 326490361
  misc_feature (1)..(484): Hordeum vulgare subsp. vulgare
  misc_feature (1)..(484): Bit score of 545.1 for HMM based on sequences of Figure 4
  misc_feature (1)..(484): Functional Homolog Of SEQ ID NO. 111
  misc_feature (118)..(136): Pfam Name: IQ Pfam Description: IQ calmodulin-binding motif
  misc_feature (360)..(459): Pfam Name: DUF4005 Pfam Description: Protein of unknown function (DUF4005)
MGKKGKWLGAVKKVFSPESKEKKEEKLRKKLAARDPSPPDLTPSTSLEVNVSMPPPPPAVPSPHQTEEVQVRDVELELELELEQEQEQSKHVTVEAAPDAPAQTSAALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSMSLNLGEGEITKAFNRRGSKPDKSSPTTPKLTRPASRLSPSTPTAKVTPIVVKKKPATPKNGLSQVDDDARSVLSVQSERPRRHSIATSTVRDDESLASSPSVPSYMAATKSARAKSRLQGSPLIDSAETTPEKGGSVSIGSAKKRLSFPAGGAPPSPMRRHSGPPKVESMVKDIAVTPQPEALAING

SEQ ID NO: 183 - protein, 472 aa, Populus trichocarpa
  misc_feature (1)..(472): Public GI ID no. 224140165
  misc_feature (1)..(472): Bit score of 600.7 for HMM based on sequences of Figure 4
  misc_feature (1)..(472): Functional Homolog Of SEQ ID NO. 111
  misc_feature (110)..(129): Pfam Name: IQ Pfam Description: IQ calmodulin-binding motif
  misc_feature (351)..(454): Pfam Name: DUF4005 Pfam Description: Protein of unknown function (DUF4005)
MGRKGKWFSSVKKALSPDPKEKTDQKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 184 - protein, 461 aa, Ricinus communis
  misc_feature (1)..(461): Public GI ID no. 255577665
  misc_feature (1)..(461): Bit score of 346.4 for HMM based on sequences of Figure 4
  misc_feature (1)..(461): Functional Homolog Of SEQ ID NO. 111
  misc_feature (119)..(137): Pfam Name: IQ Pfam Description: IQ calmodulin-binding motif
  misc_feature (346)..(437): Pfam Name: DUF4005 Pfam Description: Protein of unknown function (DUF4005)
MGKKGGWFSAFRKALSPKKSKSKKQEKDPDLVVSSYEETALAAPVPPPPPPPPLPPPPRPAEDVKLTEAESEQSKHAYSVALATAVAAEAAVAAAQAAAEVVRLTSTACYCGKSREEVAAIKIQTAFRGYLARRALRALRGLVRLKTLIQGQSVKRQAANTLRAMQTLARVQSQIRARRARMSEENQALQRQLQQKREKELEKLRSAIGEQWDDSAQSKEQQAWKNSSKSANATFMDPNNPHWGWSWLERWMAARPWESRSTVDNNDRASVKSTMSRALSIGEISRAYSRRDLDHDKPSPGAQKSTRLPSRQSPSTPPSKAPSTSSVTGKIKPPSPRGSAWGGDDDSRSLFSVQSERYRRHSIAGSSVRDDESLASSPSVPSYMAPTQSAKAKSRLPSPLGVDKDGTRDKASVASAKKRLSFSGSPAGLRRHSGPPRVNSSIMNNIEMHIEEQVNKGESGR

SEQ ID NO: 185 - DNA, 2163 bp, Gossypium hirsutum
  misc_feature (1)..(2163): Ceres Clone ID no. 1886384
  misc_feature (1)..(2163): Encodes the peptide sequence at SEQ ID NO. 186
aaacttttattccttccgtaaaggttcttctttgtttaaaactcaatttttattcctaatatctactgttcccccatgattttgcctcttaagatgggaaagaaagggaaatggttgtcctctctaaagaaagccttcttctcagagtccaagggaaagaaaaaccagaaatcaaaagaacaatttttggagaaggtgcatttggatcccactggttctgatgcagccaagttatccccacttcctcagcctgaagaggtgaaattaattgaacctgaagttgagcaaagcaagcagacttaccctgtggcagttgccaattctcctgccgttccagctcaggttgctctacaggccattcgacatcaacttaatacagatgctaggtttgccggaaaatctaaggaggaagtggcggcaatcaaaattcaagcagctttccgagcttaccttgcaaaaagggcattgcgtgctttaagaggactggctaggttgaaatcactgatggaagggcctgccgccagacggcaagcagccggttcccttcggtgcttgcagactctttctcgtatgcagtgtcagattcatgctcggagaaccaggatgatggaagaaaaccaggctcttcagaggcaactcttgcagaaacatgcgaaagagattgtgaacttgcaaatgggtgaagattgggatgacactgtgcggtcaaaggaacaaattgaggcaagcttgttgagcaaacatgaggctgccatgagaagagaaagggccatggcgtactcatttactcatcagcaaacctggaagaatgcttcgagatctatgaatccattgttcatggatccaagcaatccctcatggggatggagctggatggaacggtggatgacagcccggccatgggaggttcgtggtggcatgagagataaagaacatctcgatgaccagtcatccctaaagagtgcacgaagcaacttcggtggagaaatcagcaaagcttatgctcgttatcaactcaatttggataagcaatccacgaaggccaaccaaaagccaagccgaacttcgagcctcctatccccttctactcctaagtcagcatccataccagcccgaaagctgaagtcagcaagcccgaggagtggtgtggctggtttagatgatgaaacaagaagcatagtcagtatgaagtctgacagaaaccggagacacagcatcgcaggctcctcagtgcgtgataatgagagccttgccaactctccatcacttccaagttacatggtaccaactaagtctgcaagagttaagaccagtttgcagagccccttgggaccagaagcaaatggaacacctgagaaggatccaattggatctgctaagaaacggctttcttatccgccttcaccggccaggctaaggcgccactcctgtctgccaaaagtggacggtagcattagcaatacaaaagttgcagtggtgaatggaggggacggttttttcaaataaaaaagagatgaagtcctgatgcacgctaatccagaagaatcggaaaagaagagagaaactttgtatgtttcaaaagttagttaactaacgggattgtcgttgcacccaaaacaccccgttttcattaaagtgttgcatcgttttattaactttgagccctagtattttaaaaaaaatagtagagatctcttcttgctctctctcccttttcttgcggctagggttttgaaacccctcatcgccgttgttgccacggtgccaccacaagcggtggtaagggcggtgcgagctggcctaccctgaggtgtccccgaaggccaagccttcttaacccaaaagttgcgaaagaaaggtcttcccctccttattcggtccgatcccggtgacggaggagagccctccgcgaagaaatcacgagcgattccagtgttgcgcgacgaatggaagaggtggcgtgtggtgcgatgaaacggcgcgcgttggtggccatgctggtggggagcggcggctgaaggcttggtggctagggtttgctgaaaattttgtttgtgttgtgggcttggactattagggtttgtgaattaggtttgggtattgtcttatttgggccattttaatatataaagggactgttaataaacatttggattttcaccc

SEQ ID NO: 186 - protein, 470 aa, Gossypium hirsutum
  misc_feature (1)..(470): Ceres Clone ID no. 1886384
  misc_feature (1)..(470): Bit score of 527.9 for HMM based on sequences of Figure 4
  misc_feature (1)..(470): Functional Homolog Of SEQ ID NO. 111
  misc_feature (108)..(126): Pfam Name: IQ Pfam Description: IQ calmodulin-binding motif
  misc_feature (361)..(445): Pfam Name: DUF4005 Pfam Description: Protein of unknown function (DUF4005)
MGKKGKWLSSLKKAFFSESKGKKNQKSKEQFLEKVHLDPTGSDAAKLSPLPQPEEVKLIEPEVEQSKQTYPVAVANSPAVPAQVALQAIRHQLNTDARFAGKSKEEVAAIKIQAAFRAYLAKRALRALRGLARLKSLMEGPAARRQAAGSLRCLQTLSRMQCQIHARRTRMMEENQALQRQLLQKHAKEIVNLQMGEDWDDTVRSKEQIEASLLSKHEAAMRRERAMAYSFTHQQTWKNASRSMNPLFMDPSNPSWGWSWMERWMTARPWEVRGGMRDKEHLDDQSSLKSARSNFGGEISKAYARYQLNLDKQSTKANQKPSRTSSLLSPSTPKSASIPARKLKSASPRSGVAGLDDETRSIVSMKSDRNRRHSIAGSSVRDNESLANSPSLPSYMVPTKSARVKTSLQSPLGPEANGTPEKDPIGSAKKRLSYPPSPARLRRHSCLPKVDGSISNTKVAVVNGGDGFFK

SEQ ID NO: 187 - protein, 466 aa, Ricinus communis
  misc_feature (1)..(466): Public GI ID no. 255568402
  misc_feature (1)..(466): Bit score of 571.7 for HMM based on sequences of Figure 4
  misc_feature (1)..(466): Functional Homolog Of SEQ ID NO. 111
  misc_feature (104)..(123): Pfam Name: IQ Pfam Description: IQ calmodulin-binding motif
  misc_feature (347)..(443): Pfam Name: DUF4005 Pfam Description: Protein of unknown function (DUF4005)
METLSLNCFQFMKSKKKWFGKQHQLYSDSISIENARDLSPPLPPPQPEEVKTIETTNEQNVHAAYSVPVAAAAAEPVLPPLETTMEVVRVVKVNKFAGKSGEEMAAIKIQTAFKGYLARRALRALRGLGRLKSLMEGPTIKRQATHTLRCMQTLARVQSQIHSRRIRMSEENQALQRQLLQKHAQELEKLRMGEEWDDSLQSKEQIEANLLNKYEAAMRRERALAYSFTHQQTWKNSSRSANPIFMSSSNPTWGWSWLERWMAAHPWEKGGMTEKELSNDHSSVKTASRSMVGGEISKSYARYQLNSDKLSPAESEKVRQAMSPRSPLTPSKPGSSTIARKLKSASPRSSIGGADDDNRSIISMQSDRYRRHSIAGSSVRDDESLGSSSAVPSYMVPTESARAKSRLQSPLGVDKNGTSEKEKGPLGPAKKRLSYPPSPARPRRQLGPRKMESNLNAEIAVTNGQG

SEQ ID NO: 188 - DNA, 1726 bp, Gossypium hirsutum
  misc_feature (1)..(1726): Ceres Clone ID no. 1942871
  misc_feature (1)..(1726): Encodes the peptide sequence at SEQ ID NO. 189
gtttcttcttcaatttgtctgaaaaacataacctttccttcttctcaagatctgtttttgttctttctctgtaactgtttaccgacacacacacaaaaaaaaagttcgttcttccgaatttcttgagatctgggcattattgtttcaggatcatatcgaggaaagaaaagatggggaagaaagtaaaatggctatcttctttaaagaaagccttcaatccagagtcaaaggaaaagaaaaatcagattttggataagcaagtgcatttgggtcctagtagttctaatgcggctgcacccacattagaaactgttaatttgtcccctccacctcagccggaagatgagaaaataatcaaacccgagacggttgctgaagctaccgatgatgatgttgttgttgctccagctgttccgaccccggctgctgttacggtcgttcaacgccgacttaatatagactctcggtttgctggaaaatctatggaggaagttgcagcgatcaaaattcagacagcttttcgagtttacatggcgaaaagagcattgtgtgctttacgaggacttgtgaggctgaaatcgttaatggaaggacctgcggtgaaacggcaagtgacgagtacccttcgttgtatgcaaacactttctcgtgtgcagtgtcagattcggatgaggagaatccgtatgaccgaagaaaatcaagctcttcagagacaaatcttgcagaaacatgcgaaagagcttgtgaatttgcagatgggggaagattgggacgatagcttgcaatcgaaggaacaaatcgaagcgagcttattgagcaaacacgaggctgcaatgagacgagaaagggcaatggcttattcatttactcatcagcaaacttggaagaacggttcgaaatctatgaatccgttattcatggatatgaacaacctgacgtggggttggagttggttagaacgatggatggcagctcgaccatgggaaggacgtggcgtgacgggaaaggaaccgaacaacgaccagtcatcggtaaagagtgcacatttcgaaggagaaatcagcaaagcttacgctcgttaccaactcaatttggataataaacaatccccgaaatcgagccaaaagcctaaccgaacatcaagtcacctatccccttctccgaaaccaccttccacaccatccccaaagctgaagtccgcaagccctagcggcagtatcattgcccaggacgacgacacaagaagcatagtcagcgcgcaatccgaacggaaccgaagacacagcattgccggctcattggtgcgtgacgacgagagcttagcaagctcgccgtcacttccgagttatatggtaccaactaaatcggcaagagccaaaaccaggttgcaaagtcccttgggactagaagcaaatggtacacccgacaaaggaccgatcatgtcgaccaaaaaacgactcttgtatccaccttcaccggccaaaccgaggcggcactctggtccaccgagagtcgataccagcattattactaatacaaaaattggtgcggtgaatggtggtgtcatttaatttctctatatttttaattcatacaggttttatttgtgagatttgagaacaaactacgcataatttttagttcattgacaatttgttcattataattcttgtgctggtgttgtattgatttgtataataaattatatacattacttgtttatttt

SEQ ID NO: 189 - protein, 466 aa, Gossypium hirsutum
  misc_feature (1)..(466): Ceres Clone ID no. 1942871
  misc_feature (1)..(466): Bit score of 549.5 for HMM based on sequences of Figure 4
  misc_feature (1)..(466): Functional Homolog Of SEQ ID NO. 111
  misc_feature (109)..(126): Pfam Name: IQ Pfam Description: IQ calmodulin-binding motif
  misc_feature (353)..(444): Pfam Name: DUF4005 Pfam Description: Protein of unknown function (DUF4005)
MGKKVKWLSSLKKAFNPESKEKKNQILDKQVHLGPSSSNAAAPTLETVNLSPPPQPEDEKIIKPETVAEATDDDVVVAPAVPTPAAVTVVQRRLNIDSRFAGKSMEEVAAIKIQTAFRVYMAKRALCALRGLVRLKSLMEGPAVKRQVTSTLRCMQTLSRVQCQIRMRRIRMTEENQALQRQILQKHAKELVNLQMGEDWDDSLQSKEQIEASLLSKHEAAMRRERAMAYSFTHQQTWKNGSKSMNPLFMDMNNLTWGWSWLERWMAARPWEGRGVTGKEPNNDQSSVKSAHFEGEISKAYARYQLNLDNKQSPKSSQKPNRTSSHLSPSPKPPSTPSPKLKSASPSGSIIAQDDDTRSIVSAQSERNRRHSIAGSLVRDDESLASSPSLPSYMVPTKSARAKTRLQSPLGLEANGTPDKGPIMSTKKRLLYPPSPAKPRRHSGPPRVDTSIITNTKIGAVNGGVI

SEQ ID NO: 190 - protein, 516 aa, Hordeum vulgare
  misc_feature (1)..(516): Public GI ID no. 326527367
  misc_feature (1)..(516): Hordeum vulgare subsp. vulgare
  misc_feature (1)..(516): Bit score of 451.5 for HMM based on sequences of Figure 4
  misc_feature (1)..(516): Functional Homolog Of SEQ ID NO. 111
  misc_feature (143)..(161): Pfam Name: IQ Pfam Description: IQ calmodulin-binding motif
  misc_feature (408)..(484): Pfam Name: DUF4005 Pfam Description: Protein of unknown function (DUF4005)
MGKKPKWLGAVKKAFSPESKDQKLQRRLAAAAGGTSAPYPPDLTPSASYLEARASSAPPPLRYPDDFPEASLPPPPLPLPAPAPAPAPLPVPQTQTQEEHEIQHAAAAPPTDAPLPAAAAPPQAQAAIVQAPSSSPTLSRELAATKIQTAFRGHLARRALRALKGLVRLKSLVQGHSVKRQATSTLRCMQTLSRVQSKIRTRRIKMSEENQALQRQLLLNQELETLRMGDQWNTSLQSREQIEASMVSKQEAAARRERALAYAFSHQWKSTSRSANPMFVDPSNPHWGWSWLERWMASRPFDGRNGASEKEGSSVDRTSVNSTSLSMNLGEGEMITKADNNAYSLNPVDDGKPAASTPKPSVPASRQSPSTPSPVPARKKSTAPKSGDGDGGDDARSVVSTVRSERPRRHSIGASSVRDDASLSGSSPSVPSYMAATKSASARAKSRGQSPTLSEGAAHVETLEKGWSSVGSAKKRLSFPAGTPPPVPAPRRHSGPPKVRQAAVEGGTEERDSALV

SEQ ID NO: 191 - protein, 427 aa, Arabidopsis lyrata
  misc_feature (1)..(427): Public GI ID no. 297816500
  misc_feature (1)..(427): Arabidopsis lyrata subsp. lyrata
  misc_feature (1)..(427): Bit score of 521.4 for HMM based on sequences of Figure 4
  misc_feature (1)..(427): Functional Homolog Of SEQ ID NO. 111
  misc_feature (110)..(127): Pfam Name: IQ Pfam Description: IQ calmodulin-binding motif
  misc_feature (335)..(401): Pfam Name: DUF4005 Pfam Description: Protein of unknown function (DUF4005)
MGKSWFSAVKKALSPEPKQKKDQKPHKAKKWFGKSKKLDVTNSGEADSPRTVKDAKLKEIEEQQSRHAYSVAIATAAAAEAAVAAAQAAAEVVRLSALSRFPGKSKEEIAAIKIQTAFRGYMARRALHALRGLVRLKSLVQGKCVRRQATSTLQSMQTLARVQSQIRERRHRLSEDKQALTRQLQQKHNKDFDKTGENWNDSTLSREKVEANMLNKQVATMRRERALAYAFTHQNTWKNSSKMGSQTFMDPNNPHWGWSWLERWMAARPNENQSVILTPDNADKESSSRAMSEMVPRGKNLSARGKTPNSRRGSSPRVRQVPSEDSNSMLSIQSEQPCNRRHSTCGSIPSTRDDESFTSSFSQSVPGYMAPTQAAKARARFSNLSPLSSEKTAKKRLCFSGSPKTVRRFSGPPKLESNLTKKDTNLA

SEQ ID NO: 192 - protein, 463 aa, Arabidopsis lyrata
  misc_feature (1)..(463): Public GI ID no. 297810377
  misc_feature (1)..(463): Arabidopsis lyrata subsp. lyrata
  misc_feature (1)..(463): Bit score of 480.8 for HMM based on sequences of Figure 4
  misc_feature (1)..(463): Functional Homolog Of SEQ ID NO. 111
  misc_feature (117)..(136): Pfam Name: IQ Pfam Description: IQ calmodulin-binding motif
  misc_feature (348)..(439): Pfam Name: DUF4005 Pfam Description: Protein of unknown function (DUF4005)
MGKKAKWFSSVKKAFSPDSKKSKQKLAEGQNGVISNPPVVDNVRQSSSSSPPPALPPREVRVAEVIDERNRDLSPPSTADAVNVRATDIPVVPSSSAPGVVRRATPARFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYAYSHQQNWKSNSKSGNPMFMDPSNPTWGWSWLERWMAGRPLESSEKEQNSNSNNDNAASVKGSINRNEAAKSITRNGSTQPNTPSSARGTPRNKNSFFSPPTPSRLIQSSRKSNDDDAKSTISVLSERNRRHSIAGSSVRDDESLAGSPALPSYMVPTKSARARLKPQSPLGGTTQENEGFTDKASAKKRLSYPTSPALPKPRRFSAPPKVESGGVAVTNEAGS

SEQ ID NO: 193 - protein, 499 aa, Selaginella moellendorffii
  misc_feature (1)..(499): Public GI ID no. 302762472
  misc_feature (1)..(499): Bit score of 426.4 for HMM based on sequences of Figure 4
  misc_feature (1)..(499): Functional Homolog Of SEQ ID NO. 111
  misc_feature (117)..(136): Pfam Name: IQ Pfam Description: IQ calmodulin-binding motif
  misc_feature (380)..(448): Pfam Name: DUF4005 Pfam Description: Protein of unknown function (DUF4005)
MGKKKWFSAVKKAFGSPSKNEKEKTDTSSVKESEKLDNNNRKQIQDENQHQKKWNGATDDNSVLQTEDEQSKHAMAVAVATAAAAEAAVAAAQAAAAVVRLTGGRPSVHGGKPKEEWAAVKIQTAFRGYLARRALRALRGLVRLQALVRGHAVRRQATMTLRCMQALVRVQARVRARRVRMAEESQTLKNQVWQKRLEEQEALPDVETSVEVWDHSVKTAEEIQAKMQSKQEAAMKRERALAYAFSHQLWRSEPKDASAMYLDGDPEKSHWGWSWLERWMTARPWEGRAMEKDAPDGFSLKSTEDVVTKILEVDSGRFSSSGRRKQENELNSPSLTNKSNGNHTPSARGMLHSASPRSTRLVDDRTPRSTINNSLSAIAVKHPNNSSISSSVRDDESLASYPSVPSYMAPTESTRARSRSSSTPKQRPATPDKDAAKKRLSYPLADGVVPNSGPLRSSRNSGITQKSPGLKGKPGTGMSLQDSIGSDAPLLGEHTKRFR

SEQ ID NO: 194 - protein, 498 aa, Selaginella moellendorffii
  misc_feature (1)..(498): Public GI ID no. 302815615
  misc_feature (1)..(498): Bit score of 425.5 for HMM based on sequences of Figure 4
  misc_feature (1)..(498): Functional Homolog Of SEQ ID NO. 111
  misc_feature (117)..(136): Pfam Name: IQ Pfam Description: IQ calmodulin-binding motif
  misc_feature (381)..(466): Pfam Name: DUF4005 Pfam Description: Protein of unknown function (DUF4005)
MGKKKWFSAVKKAFGSPSKNEKEKTDTSSVKESEKLDNNNRKQIQDENQNQKKWNGATDDNSVLQTEDEQSKHAMAVAVATAAAAEAAVAAAQAAAAVVRLTGGRPSVHGGKPKEEWAAVKIQTAFRGYLARRALRALRGLVRLQALVRGHAVRRQATMTLRCMQALVRVQARVRARRVRMAEESQTLKNQVWQKRLEEQEALPDVEASVEVWDHSVKTAEEIQAKMQSKQEAAMKRERALAYAFSHQLWRSEPKDASAMYLDGDPEKSHWGWSWLERWMTARPWEGRAMEKDAPDGFSLKSNEDVVTKILEVDSGRFSSSGRRKQENELNSPSLTNKSNGNHTPSARGMLHSASPRSTRLVDDRTPRSTINNSLPAIAVKHPNNSSISSSVRDDESLASYPSVPSYMAPTESTRARSRSSSTPKQRPATPDKDAAKKRLSYPLADGVVPNSGPLRSTRNSGITQKSPGLKGKPTGMSLQDSIGSDAPLLGEDTKRFR

SEQ ID NO: 195 - protein, 499 aa, Picea sitchensis
  misc_feature (1)..(499): Public GI ID no. 116787496
  misc_feature (1)..(499): Bit score of 393.7 for HMM based on sequences of Figure 4
  misc_feature (1)..(499): Functional Homolog Of SEQ ID NO. 111
  misc_feature (121)..(140): Pfam Name: IQ Pfam Description: IQ calmodulin-binding motif
  misc_feature (372)..(453): Pfam Name: DUF4005 Pfam Description: Protein of unknown function (DUF4005)
MDKKGSCFSVLKWAFCAKQKSHATKQGKKKGGCCFGSFRHHEPAAPKEDTRVKKTLGEGQEIRNEHEKPLVEVKEEQNSHASAVAVATAAAAEAAAAAAHAVAKVVRLTESYYSTNSPEECAAIKIQTAFRGYLVRRNFHTLRGLMRLQALVQGQSVRRQATNTMRCMQALVRVHSQICSRRIRMFEENQALQHHLQQKYEKELENRTSNSEADHQQDWESSLLTKEEIEARLQSKIEAAIKRERALAYAFSHHLWKNPPKSVQTMLMEIDPDKPHWGWSWLERWMATRPWDNHRMTMKENSTRKLQTIGEIGQKTSHIGLKQHNAEVTNIGTIKSDPFTPLSKPSIPNKMPLTGTDIKSDVNVLRSERPRYSSRYGVAGTSSLRDDESLMSSPRIPNYMASTESAKAKVRSQSTPKQRPGTPDTEPTSYRRKRLSFPLSEASSGPYRSTKGSMFPHTSPSLKGISGTSKSKKSVSSLRDLSIESDNSSLNWGHRKPFR

SEQ ID NO: 196 - protein, 321 aa, Zea mays
  misc_feature (1)..(321): Public GI ID no. 224029961
  misc_feature (1)..(321): Bit score of 375.0 for HMM based on sequences of Figure 4
  misc_feature (1)..(321): Functional Homolog Of SEQ ID NO. 111
  misc_feature (206)..(291): Pfam Name: DUF4005 Pfam Description: Protein of unknown function (DUF4005)
MQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 197 - protein, 454 aa, Arabidopsis thaliana
  misc_feature (1)..(454): Public GI ID no. 15232741
  misc_feature (1)..(454): Bit score of 339.9 for HMM based on sequences of Figure 4
  misc_feature (1)..(454): Functional Homolog Of SEQ ID NO. 111
  misc_feature (109)..(126): Pfam Name: IQ Pfam Description: IQ calmodulin-binding motif
MVKKAKWLKNVKKAFSPDSKKLKHESVECQDSVISYPVLIATSRSSSPQFEVRVDEVNYEQKKNLYPPSSDSVTATVAHVLVDSPPSSPESVHQAIVVNRFAGKSKEEAAAILIQSTFRGHLARRESQVMRGQERLKLLMEGSVVQRQAAITLKCMQTLSRVQSQIRSRRIRMSEENQARHKQLLQKHAKELGGLKNGGNWNYSNQSKEQVEAGMLHKYEATMRRERALAYAFTHQQNLKSFSKTANPMFMDPSNPTWGWSWLERWMAGRPWESSEKEQNTTNNDNSSVKNSTNRNSQGGETAKSSNRNKLNSSTKPNTPSASSTATRNPRKKRPIPSSIKSKSSDDEAKSSERNRRPSIARPSVSDDETLSSSTARRSSNLIPTTKSARGKPKSQTSSRVAVTTSTTEESSILPEKAPAKKRLSTSASPAPKPRRSSAPPKVEKGVLKAERTP

SEQ ID NO: 198 - protein, 602 aa, Selaginella moellendorffii
  misc_feature (1)..(602): Public GI ID no. 302806862
  misc_feature (1)..(602): Bit score of 259.9 for HMM based on sequences of Figure 4
  misc_feature (1)..(602): Functional Homolog Of SEQ ID NO. 111
  misc_feature (118)..(137): Pfam Name: IQ Pfam Description: IQ calmodulin-binding motif
  misc_feature (463)..(500): Pfam Name: DUF4005 Pfam Description: Protein of unknown function (DUF4005)
MGKSTRWLLALIGLKKSSKKSSVEEQDVRKSSKDKRRWSFGKSAAAPADFAKPSSSSAREMDHSQNEQAKHAIAIAAASAAAAEAAVAAAHAAAAVVRLTGAANYASPVFELISREEWAAIKIQTAFRGYLARRALRALKAVVRIQALFRGHRVRKQAAITLRCMQALVRVQARVRARRVRMSKEGQAVQQQLLERRGRYRKSMDGWIASTGTVEDFHAKNERKHLGAMKRERALAYAFSQSNQLTKFLAELQSRTASPMVIDCEPDTPHWGWSWLERWMAARPWENPFEATSPVDSGCTKIVEVDYNNQSTNKLNPAKAPPPPPLSSTPPSSNTAIAKPAKKRSGSASESIPDAHKIVIPSPTNPAPPISTDRHGLSPNAQNLLSHPSPVIDHHHHADQSSSAAAIAASPKDLLALDDCFAKNTLKPLKNAAAAGAGTSAENQSFVQDFQQGIIRDMDLTLAGSSSELPAAAVPSYMATTQSSKAKVRSHSTPKQRPEQLLGLTMPDTPRKSMRNSMNGGHLLLAATTASGSFSSATAAANNAGSIAGALLRRGGSASSSQHGNGRGFSTGSMALDRSLISFKDGHASLSINGDMRKPFRF

SEQ ID NO: 199 - protein, 603 aa, Selaginella moellendorffii
  misc_feature (1)..(603): Public GI ID no. 302772817
  misc_feature (1)..(603): Bit score of 257.0 for HMM based on sequences of Figure 4
  misc_feature (1)..(603): Functional Homolog Of SEQ ID NO. 111
  misc_feature (118)..(137): Pfam Name: IQ Pfam Description: IQ calmodulin-binding motif
  misc_feature (465)..(500): Pfam Name: DUF4005 Pfam Description: Protein of unknown function (DUF4005)
MGKSTRWLLALIGLKKSSKKTSVEEQDVRKSSKDKRRWSFGKSAAAPADFVKSSSSSAREMDHSQNEQAKHAIAIAAASAAAAEAAVAAAHAAAAVVRLTGAANYASPVFELISREEWAAIKIQTAFRGYLARRALRALKAVVRIQALFRGHRVRKQAAITLRCMQALVRVQARVRARRVRMSKEGQAVQQQLLERRGRYRKSMDGWIASTGTVEDFHAKNERKHLGAMKRERALAYAFSQSNQLTKLLAELQSRTASPMVIDCEPDTPHWGWSWLERWMAARPWENPFEATSPVDSGCTKIVEVDYNNQSANKLNPAKAPPPPPLSSTPPSSNTAIAKPAKKRSGSASESIPDAHKIVIPSPTNPAPPIATDRHGLSPNAQNLLSHPSPVIDHHHHADQSSSAAAIAASPKDLLALDDCFAKNTLKPLKNAAAAGVGTSAENQSFVQDFQQGIIRDMDLTLAGSSSELPAAAVPSYMATTQSSKAKVRSHSTPKQRPEQLLGLTMPDTPRKSMRNSMNGGHALLLAATTASGSFSSATAAANNAGSIAGALLRRGGSASSSQHGNGRGFSTGSMALDRSLISLKDGHASLSINGDMRKPFRF

SEQ ID NO: 200 - protein, 527 aa, Arabidopsis thaliana
  misc_feature (1)..(527): Public GI ID no. 240254538
  misc_feature (1)..(527): Bit score of 305.9 for HMM based on sequences of Figure 4
  misc_feature (1)..(527): Functional Homolog Of SEQ ID NO. 111
  misc_feature (150)..(167): Pfam Name: IQ Pfam Description: IQ calmodulin-binding motif
MGKNWLTCVSVACLSPGKDKKNQKPEKPKRKWSFGKQKSRESFDFPLEETPPVDPSPSSVHRPYPPPPPLPDFAPQPLLPPPSPPPPPPAYTINTRIYGESKESKNRQALALASAVAAEAAVVAAHAAAEVIRLTTPSTPQIEESKEETAAIKIQNAYRCYTARRTLRALRGMARLKSLLQGKYVKRQMNAMLSSMQTLTRLQTQIQERRNRLSAENKTRHRLIQQKGHQKENHQNLVTAGNFDSSNKSKEQIVARSVNRKEASVRRERALAYAYSHQQTWRNSSKLPHQTLMDTNTTDWGWSWLERWMASRPWDAESIDDQVSVKSSLKRENSIKSSPARSKTQKSASQSSIQWPVNNDTKSRKIEVTNRRHSIGGGSSENAKDDESVGSSSSRRNSLDNTQTVKSKVSVETTSNVSNAQTVKPKANVGAKRNLDNTKTLKSKSSVGTTGNLANTEAVKSKVNVGTTSMPKKEVVADKKKPPQMVLPKKRLSSSTSLGKTKKLSDSDKATTGVANGEKKRRNGGSS

SEQ ID NO: 201 - protein, 457 aa, Arabidopsis lyrata
  misc_feature (1)..(457): Public GI ID no. 297833734
  misc_feature (1)..(457): Arabidopsis lyrata subsp. lyrata
  misc_feature (1)..(457): Bit score of 329.1 for HMM based on sequences of Figure 4
  misc_feature (1)..(457): Functional Homolog Of SEQ ID NO. 111
  misc_feature (109)..(122): Pfam Name: IQ Pfam Description: IQ calmodulin-binding motif
MVKKAKWLKNVKKAFSPDSKKLKHESVECQDSVISYPVLIATSRSSPPQFEVRVDEVNYEQKKNLCPPSSVSVTPTVAHVLVDSPPSSPESVHQAIVDDRFAGKSKEDAAAILIQSTFRGNLSLSLSCVMRGQARLKLLMEGSVVQRQAAITLKCMQTLSRVQSQIRSRRIRMSEENQARHKQLLQKHAKELGGLKNGGNWNDSNQSKEQVEAGMLHKYEATMRRERALAYAFTHQQNLKSNSKTANPMFMDPSNPTWGWSWLERWMAGRPWESSEKEQNTTNNNNNENSSVKNSTNRNSHGGETAKSLNRNKLNISTQSNTPSSSSTATRNPRKKRPIPSPIKSKTSDDEAKSSEKNRRHSTARSSVSDDETLTSSTAKRSNHLIPTTKPVRGKPKPQSSSRAAVTTTTTEENSVLPEKAPAKKRLSTSASPAPKPRRSSAPPKVEKGALKAERTP

SEQ ID NO: 202 - protein, 516 aa, Arabidopsis thaliana
  misc_feature (1)..(516): Public GI ID no. 2739366
  misc_feature (1)..(516): Bit score of 294.6 for HMM based on sequences of Figure 4
  misc_feature (1)..(516): Functional Homolog Of SEQ ID NO. 111
  misc_feature (139)..(156): Pfam Name: IQ Pfam Description: IQ calmodulin-binding motif
MKDLSENFRRKWKPEKPKRKWSFGKQKSRESFDFPLEETPPVDPSPSSVHRPYPPPPPLPDFAPQPLLPPPSPPPPPPAYTINTRIYGESKESKNRQALALASAVAAEAAVVAAHAAAEVIRLTTPSTPQIEESKEETAAIKIQNAYRCYTARRTLRALRGMARLKSLLQGKYVKRQMNAMLSSMQTLTRLQTQIQERRNRLSAENKTRHRLIQQKGHQKENHQNLVTAGNFDSSNKSKEQIVARSVNRKEASVRRERALAYAYSHQQTWRNSSKLPHQTLMDTNTTDWGWSWLERWMASRPWDAESIDDQVSVKSSLKRENSIKSSPARSKTQKSASQSSIQWPVNNDTKSRKIEVTNRRHSIGGGSSENAKDDESVGSSSSRRNSLDNTQTVKSKVSVETTSNVSNAQTVKPKANVGAKRNLDNTKTLKSKSSVGTTGNLANTEAVKSKVNVGTTSMPKKEVVADKKKPPQMVLPKKRLSSSTSLGKTKKLSDSDKATTGVANGEKKRRNGGSS

SEQ ID NO: 203 - protein, 516 aa, Arabidopsis lyrata
  misc_feature (1)..(516): Public GI ID no. 297825811
  misc_feature (1)..(516): Arabidopsis lyrata subsp. lyrata
  misc_feature (1)..(516): Bit score of 297.9 for HMM based on sequences of Figure 4
  misc_feature (1)..(516): Functional Homolog Of SEQ ID NO. 111
  misc_feature (139)..(156): Pfam Name: IQ Pfam Description: IQ calmodulin-binding motif
MKDLSENFRRRWKPEKPKRKWSFGKQKSRDSFDFPVEETPTVDPSSSSVHRPSPPPPPLPDFAPQPLLPPPSPPPPPPAYTSNTRLYVDSKEAKNRQALALASAVAAEAAVVAAHAAAEVVRLTTPSTHQTEESKEETAAIKIQNAYRCYKARRTLRALRGMARLKSLLQGKYVKRQMNAMLSSMQTLTRLQTQIQERRNRLSAENKTRHRLIQQKGHQKENNQNLVTAGNFDSSNKSKEQIVARSVNRKEASVRRERALAYAYSHQQTWRNSSKLPHQTLMDTNTTDWGWSWLERWMASRPWDAESIDDQISLKNSLKRENSIKTSPARSKTLKSASQSSIQWPVNNDTKSKKIEVANRRHSIGGGSSANAKDDESVGSSSSRRNSLDNTQTVKAKVSVETTSNVTNAQPVKPKASVGTKRNLDNTKALKSKSSVGTTENLANTQAVKSKVNVGTTGLPKKEVVSDKKKPPQMVLPKKRLSSSTSLGKTKKLSDSDKATTGAANGEKKRRNGGSS

SEQ ID NO: 204 - DNA, 1904 bp, Zea mays
  misc_feature (1)..(1904): Ceres Clone ID no. 375578m1
  misc_feature (1)..(1904): Encodes the peptide sequence at SEQ ID NO. 205
acatcctaatcgaaaacccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaataacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 205 - protein, 136 aa, Zea mays
  misc_feature (1)..(136): Ceres Clone ID no. 375578m1
  misc_feature (1)..(136): Bit score of 174.3 for HMM based on sequences of Figure 4
  misc_feature (1)..(136): Functional Homolog Of SEQ ID NO. 111
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSRE

SEQ ID NO: 206 - protein, 311 aa, Zea mays
  misc_feature (1)..(311): Ceres Clone ID no. 375578m2
  misc_feature (1)..(311): Bit score of 529.5 for HMM based on sequences of Figure 4
  misc_feature (1)..(311): Functional Homolog Of SEQ ID NO. 111
  misc_feature (184)..(292): Pfam Name: DUF4005 Pfam Description: Protein of unknown function (DUF4005)
MTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 207 - protein, 469 aa, Cucumis melo
  misc_feature (1)..(469): Public GI ID no. 307135879
  misc_feature (1)..(469): Cucumis melo subsp. melo
  misc_feature (1)..(469): Bit score of 218.9 for HMM based on sequences of Figure 4
  misc_feature (1)..(469): Functional Homolog Of SEQ ID NO. 111
  misc_feature (121)..(140): Pfam Name: IQ Pfam Description: IQ calmodulin-binding motif
  misc_feature (360)..(427): Pfam Name: DUF4005 Pfam Description: Protein of unknown function (DUF4005)
MGKKGTGWFSTVKKVFKSNNNTPSKDYSPHSLLNKKESANVEKWQHNAPDVISFEQFPIENSTEITNNESVQSTPRIEGRDHAIVVAAATAAAAEAAVAAAEAAAKVVRLAGYGWKSREDRAATLIQAYYRGYLARRALRALKGLVRLQALVRGHNVRKQAQMTMRCMQALVRVQARVRARRLQLANQNYNKRIAEQENDEDEDDEEEKLLKNKLKKYEMESWDGRVLSVEKIKENSSRKRDALMKRERALAYAYSYQQQHQRRQDEERILQLGEDVNDLGFRHDKGEYGWNWLEHWMSSQPYNNVRQSTTRESYITPTTATTATDDMSEKTVEMDPIALARLNLDPIDIGRSVSGPYSSRQPISKNIPSYMASTQSAKAKVRNQGMVKHQGPNWNKSMRRRSVFGSGCDSSSSGGGTMAYQGQRSPILMNNGPRLSPIHIMGCGPDYPGGEDWALPPLGVNSWRAGFA

SEQ ID NO: 208 - DNA, 2145 bp, Arabidopsis thaliana
  misc_feature (1)..(2145): Ceres Annot ID no. 878355
  misc_feature (1)..(2145): Encodes the peptide sequence at SEQ ID NO. 209
actctcaatatcactattaaatatctttctcttttcacttcttcactttcctcgattcctgagttttcgatccttttgttctctaaccaccggtttcctctttaaccggtctctggataatcatcataatcattaggatcatcaagataaggaatctttttgagtatatctctacaccaaatcgaatctatggatcaaaaagttagacagtttgaggtttgcactcaagacggtagcgttgatcgtcacggcaatccagctatccgagctaataccggcaaatggctcactgctattctcattctagtgaatcaaggactagctacgcttgcgttcttcggtgtaggagtgaatttggttctgtttctgactcgagtgatgggacaagacaatgcagaagcggctaataatgttagtaaatggacaggaactgtctatatcttctctttgcttggtgctttcctcagtgactcttattggggacgttacaagacttgtgctatctttcaagcaagtttcgttgcagggttgatgatgttatctttatctactggtgcgttattgcttgaaccaagtggttgtggagttgaagattcgccgtgtaagcctcattcgacgtttaagacggttctgttttatctgtcggtgtatctaatcgcgttagggtatggtggttatcagccgaacatagctacttttggagctgatcagtttgatgcggaggattccgttgaaggacactcgaaaatcgcgtttttcagttacttttacttggctctgaatcttggatcgctcttctcaaatactgtcttgggttactttgaggatcaaggggaatggccgcttggattttgggcgtctgctggctctgcttttgcggggttagtgcttttcttgattggcacgccaaagtaccgacactttacgcctagagagagtccttggtctagattctgccaagtgttggttgctgcaacaagaaaggctaagattgatgtgcaccatgaagagttgaatctctatgattctgagactcaatacactggagataagaagattcttcataccaaaggcttcagattcttggatagagctgctattgttacacctgatgatgaggctgagaaagtagagagcggatcgaaatacgatccatggaggctctgctcggtgactcaagtcgaagaagtgaaatgtgtattaagactcttaccaatctggctctgcaccatcctctactctgtggttttcacccaaatggcttcactgttcgttgtgcaaggagcagcgatgaagacaaacatcaaaaacttccggattccagcttcaagcatgtctagtttcgacattctcagtgtcgccttcttcatcttcgcatacaggcggtttcttgatccactctttgcaagacttaacaaaacagaacgcaacaaaggtctcactgagcttcagaggatggggattgggcttgtgattgcgataatggcgatgatttccgcaggaatcgtagagatacacagactgaaaaataaggaaccggaaagtgctacttcgatctcaagctccagcactttgagcattttttggcaagtacctcagtacatgttgataggtgcatcagaagtgttcatgtacgttggtcaactcgagttcttcaacagccaagcaccaaccgggctaaagagctttgcaagcgcgctatgtatggcttcaatatctcttgggaactatgtaagcagtttgttagtttccattgtcatgaagatctctacaacagatgatgtgcatggctggattcctgaaaatctcaacaaaggacacttggagagattctacttccttttagctggtctaaccgctgctgatttcgtggtttacttgatttgtgccaaatggtacaagtatattaaatctgaagcaagtttctctgagtccgtaactgaagaggaggaagtctgagtcaggagctagagagttttgtgttttattttaatgctgtgaagctttttacagtaatttgtttaaagctgagcttgttctgtgatataaactggtcttattgtgtttttatttttgggttatactcttgtgcaaagtttagttgatgtttctcaataaaggataagttgattccacagttccaac

SEQ ID NO: 209 - protein, 589 aa, Arabidopsis thaliana
  misc_feature (1)..(589): Ceres Annot ID no. 878355
  misc_feature (1)..(589): Bit score of 1005.9 for HMM based on sequences of Figure 6
  misc_feature (1)..(589): in Figure 6
  misc_feature (101)..(508): Pfam Name: PTR2 Pfam Description: POT family
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 210 - DNA, 1821 bp, Populus trichocarpa
  misc_feature (1)..(1821): Ceres Annot ID no. 1472338
  misc_feature (1)..(1821): Encodes the peptide sequence at SEQ ID NO. 211
atggcctgcttaaatatttgcaaagaggaaggaagcgtgcaggggaagctcgtgaagaaggagcaggaggtttgcactagggatggaagcgttgatcgacatggcgatcctgcaatccgggggaggactgggacttggttcgctggaatcctcatattagtgaatcaagggctggcgacgttggccttctttggggtaggagtgaacttggttctgtttttgacaagagtgttgggtcaagacaatgccgaagctgcaaacaacgtcagcaaatggactggaactgtttacatattctctcttctcggcgccttcctcagcgactcttactgggggaggtacaagacttgtgctatcttccaggccatcttcgtcactggtctggtattgttgtcactgtcttcctacttattcttactcaaaccgagaggctgtggtgatgaacattctccatgtggatcccattcaacataccagaatgtctttttctacttctccatctatcttgttgcccttggaaatggaggctaccagcctaacattgctacctttggggctgatcagtttgatgaagaggaccctaaagaaggccactctaagatagctttctttagctacttttacttggctctcaaccttggttctctcttttcgaacaccatattgggctattttgaggaccggggcatgtgggcgttaggattctgggcatctgctggctctgctcttttggcactggtcttgtttctcattgggactcccaggtatagacacttcacccccaagggcaaccccctctctaggtgttgccaggtgatggttgctgcaacaagaaaatggaaggttcagaggatgccaaatcaaggtgatgatcagtttgaatcggatgtcccaaaggacggttccaaaaatggggatagaaagatactacacacccaaggattcagattcttggatagagctgcaattattacatccaaggattatacagagaatcgcattcacgatccatggcgtgtctgcacagtaaatcaagttgaagaatttaaatgcatcctacgactcctccctatctggctgtgcacaattctttactctgtagttttcactcaaatggcatcactcttcgtcgaacaaggtgctgatatgaaaactacgatttcgaaattccacattcctccagcaagcatgtctagtttcgacatactcagtgttgcggctttcatattcatctataggagagttcttgatccccttgttgccagaataagaaaggaccctaagggcctgacagagcttcagaggatggggattggtctagttatcgcaataattgcaatggtttcggcagggattgtagagctattcaggttgaagtacgcaagaaaagactgtccaagatgcgaaagtgcgagttctttgagcatactttggcaaattcctcaatatgttctgataggagcatctgaggtgttcatgtatgtggggcaattagaattcttcaatgggcaagcacctgatggattgaagagcttcggcagtgcactttgcatgacatcaatatctctaggcaactatgtgagtagcttgctagtaacagtcgtaatgaagatatctaccagagatgagatgccaggatggatcccaggaaaccttaacaagggtcatctagacagatttttcttcctcttggcagttttgacaaccgcagatcttgttctgtacattatctgtgctagatggtacaagtacatcaagtttgagaggcagcaggaagcggatagtatattaagcaatgaagaggcagaccttagagtttga

SEQ ID NO: 211 - protein, 606 aa, Populus trichocarpa
  misc_feature (1)..(606): Ceres Annot ID no. 1472338
  misc_feature (1)..(606): Bit score of 1048.1 for HMM based on sequences of Figure 6
  misc_feature (1)..(606): Functional Homolog Of SEQ ID NO. 209
  misc_feature (1)..(606): in Figure 6
  misc_feature (114)..(520): Pfam Name: PTR2 Pfam Description: POT family
MACLNICKEEGSVQGKLVKKEQEVCTRDGSVDRHGDPAIRGRTGTWFAGILILVNQGLATLAFFGVGVNLVLFLTRVLGQDNAEAANNVSKWTGTVYIFSLLGAFLSDSYWGRYKTCAIFQAIFVTGLVLLSLSSYLFLLKPRGCGDEHSPCGSHSTYQNVFFYFSIYLVALGNGGYQPNIATFGADQFDEEDPKEGHSKIAFFSYFYLALNLGSLFSNTILGYFEDRGMWALGFWASAGSALLALVLFLIGTPRYRHFTPKGNPLSRCCQVMVAATRKWKVQRMPNQGDDQFESDVPKDGSKNGDRKILHTQGFRFLDRAAIITSKDYTENRIHDPWRVCTVNQVEEFKCILRLLPIWLCTILYSVVFTQMASLFVEQGADMKTTISKFHIPPASMSSFDILSVAAFIFIYRRVLDPLVARIRKDPKGLTELQRMGIGLVIAIIAMVSAGIVELFRLKYARKDCPRCESASSLSILWQIPQYVLIGASEVFMYVGQLEFFNGQAPDGLKSFGSALCMTSISLGNYVSSLLVTVVMKISTRDEMPGWIPGNLNKGHLDRFFFLLAVLTTADLVLYIICARWYKYIKFERQQEADSILSNEEADLRV

SEQ ID NO: 212 - protein, 589 aa, Vitis vinifera
  misc_feature (1)..(589): Public GI ID no. 157344683
  misc_feature (1)..(589): Bit score of 1048.2 for HMM based on sequences of Figure 6
  misc_feature (1)..(589): Functional Homolog Of SEQ ID NO. 209
  misc_feature (1)..(589): in Figure 6
  misc_feature (98)..(505): Pfam Name: PTR2 Pfam Description: POT family
MYLNPLSECTFDGSVDRHGHPAVRARTGNWVTAILILVNQGLATLAFFGVGVNLVLFLTRVLGQDNATAANNVSKWTGTVYIFSLLGAFLSDSYWGRYKTCAIFQVIFVIGLVLLSLSSYIFLLKPNGCGDKEFPCGSHSTFEISFFYLSIYLIALGNGGYQPNIATFGADQFDEDNPKESHSKVAFFSYFYLALNLGSLFSNTILGYFEDGGRWVLGFWASSASAILALILFLFGIPRYRHFKPSGNPLSRFCRVVVAATRKWKVEMPPEGEDLYEVDGDDCSGNCRRKMLHTQGFKFLDKAAVLTAKEREQEDKESRSPWRICTVTQVEEVKCILRLLPIWLCTILYSVVFTQMASLFVEQGAAMKTTLLGFHIPPASMSSFDIVSVAAFIFIYRRVLDPLVARLKGTKARGLTELQRMGIGLIIAIIAMVAAGIVEWFRLKYAKKDCRQCESESSLSIFWQIPQYVLIGASEVFMYVGQLEFFNDQAPDGLKSFGSALCMTSISLGNYVSSLLVTIVMKFSTRDQMPGWIPSNLNKGHLDRFYFLLAALTMADFGVYIICAKWYKSIKLEGKYEDSNSKGSDDVMV

SEQ ID NO: 213 - protein, 589 aa, Medicago truncatula
  misc_feature (1)..(589): Public GI ID no. 87240677
  misc_feature (1)..(589): Bit score of 1013.6 for HMM based on sequences of Figure 6
  misc_feature (1)..(589): Functional Homolog Of SEQ ID NO. 209
  misc_feature (1)..(589): in Figure 6
  misc_feature (100)..(505): Pfam Name: PTR2 Pfam Description: POT family
MVNKELEVCTLDGSIDSHGHPAVRERTGTWFAGILILVNQGLATLAFFGVGVNLVLFLTRVMGQDNADAANNVSKWTGTVYIFSLLGAFLSDSYWGRYITCAIFQVIFVVGLVALSLTSYIFLLKPNGCGSKELPCGTHSSYETTLFYVSIYLVALGNGGYQPTIATFGADQFDESDPSEQHSKIAFFSYFYLALNIGSLFSNTILDYFEDDGLWTLGFCVSAGSAALALVLFLCGTSKYRYFKPVGNPLPRFCQVFVAAIRKWKVQMFDGEDKLHEVEDCLSNGGRKMYHTQGFRFLDKAAFITPKDLKQMEENKCSPWFLSTVTQVEEVKCILRLLPIWLCTILFSVVFSQMASLFVEQGAAMETKISTFHIPPASMSSFDILSVVSFIFIYRRILDPLVARFTKKSKGITELQRMGIGLVLAIIAMVSAGLVEIFRLKYAIKEEKNCSHCEGTSSLSIFWQVPQYVLIGASEVFMYVGQLEFFNSQAPDGLKSFGSALCMTSISLGNYVSSLLVAIVMKISTRNEGMLGWIPGNLNMGHLDRFYFLLAALTAADLLVYIAMARWYKYVKFHGNNIEQGNNIEENVV

SEQ ID NO: 214 - protein, 584 aa, Oryza sativa
  misc_feature (1)..(584): Public GI ID no. 115448297
  misc_feature (1)..(584): Oryza sativa Japonica Group
  misc_feature (1)..(584): Bit score of 1026.2 for HMM based on sequences of Figure 6
  misc_feature (1)..(584): Functional Homolog Of SEQ ID NO. 209
  misc_feature (1)..(584): in Figure 6
  misc_feature (105)..(503): Pfam Name: PTR2 Pfam Description: POT family
MAPTAVDSKRISDITEDGSMDRRGNPAVKAKTGNWRSSILLLVNYGLVTCAFFGVGVNLVVFLRRVLHQDNAEAANSISKWTGTVYIFSLIGAFMSDSYWGRYITCAIFQMIYVTGLVILSLASWFLLVKPTGCGAAGEHCDAPSSAGVALFYLSTYMIAFGNGGYQPSIATFGSDQFDETDPREARSKVAFFSYFYLALNVGSLFSNTVLVYYEDEGRWVMGFWVSAAAAAMALVLFLLGTPNYRHFKPTGNPLTRIAQVFVAAFRKWRAEVPRSELLHEVDGDESQIAGIRKILHSDQIRFLDKAATVTEEDYCTPENMQDPWRLCTVTQVEEVKCILKMLPIWLCTIVYSVVFTQMASLFVEQGTTMNTNIGSFHVPAASMSVFDILSVLAFIAIYRRVLVPVMSRLSGNPQGLTELQRMGVGLVVGMAAMVVAGVVEVERLKRVGAPDQPSSLSVLWQVPQYALIGASEVFMYVGQLEFFNGQAPDGVKSFGSSLCMASISLGNYVSIMLVSVVTSLTAGDRRPGWIPGNLNSGHLDRFYFLLAALSLVDLAVYVACAVWYKGIKLDSNEEKANKITVHV

SEQ ID NO: 215 - DNA, 2233 bp, Panicum virgatum
  misc_feature (1)..(2233): Ceres Clone ID no. 1844568
  misc_feature (1)..(2233): Encodes the peptide sequence at SEQ ID NO. 216
gcatgttcagctgttacactttcgcaatggataaccctgttcatccctagctaacacgaggtcttatatatcacaggctaaatcttgctggcaatacgatctttcaacttctccttacagcaagactgaagaaattcctgaacaagctgcggagaacagattaagcaagcaaggctgatagtgaagtttcagaaagctcattgaacgacgtgatggatcccaccactgttgaatcgaaatgggtgtctcccaccactgaagatgggtcaatggacaggagaggaaacccagctgccaaagcagcatctggaagatggagatctgccatcctgctgctcgccaactacgggctcgtgacgtgcgccttcttcggcgtcggtgtgaacctggtggtgttcctgcggcgggtgctccaccaggacaacgccgaggcggccaacaacatcagcaagtggaccggcaccgtctacatcttctcgctcatcggcgccttcctcagcgactcctactggggccgttacgtcacctgcgccatcttccagatcatctacgtgacgggcctggtgattctgtcgcttgcgtcatggttcttgctggtgaagccctccggctgcggcggcgtcgatgcgcgctgcgacgagccgtcggcgcccggcgtcgcgctcttctacctgtccacctacatgatcgcgttcggcaacggcgggtaccagccttcgatcgccacgttcgggtcggaccagttcgacgagacggaccccaaggaggcgcgctccaaggtcgccttcttcagctacttctacctggcgctcaacgtcgggtccctcttctccaacacggtgctggtgtactacgaggactcgggccgctgggtcatggggttctgggtctcggcggccgccgcggcgctggcgctcgtgctcttcctgctcggcacccccaactaccggcacttcaagccgagcggcaacccgctgacgcgcgtcgcgcaggtgttcgtcgccgcgctccgcaagtggcacgcggaggtgccccgagaagagttcctccacgaggtggaaggagaggaccccaaggtctcgggcatccgcaagatccttcacagcgacgagctcaggttcctcgacagggcggcgacggtcaccgaggaggagtacggcgcgccggagaagatgaaggacccgtggcggctctgcacggtgacgcaggtggaggaggtgaagtgcatcctgaagatgctgcccatctggctgtgcacgatcgtgtactcggtggtgttcacccagatggcgtccctgttcgtggagcagggcgccaccatgaacaccaacatcgggtcgttccacttccccgccgcgagcatgtcgctgttcgacatcctcagcgtgctggcgttcatcgccatctaccgccgcgtgctggtccccgtgatggcgcggctgtcgggcaacccgcagggcctgacggagctgcagcgcatgggcgtggggctcgtgatcggcatggcggccatggtggtggcgggcgcggtggaggtggagcggctgcggcgcgtggcggccccggaccagccgagctcgctgagcgtgctgtggcaggtgccgcagtacgcgctgatcggggcgtcggaggtgttcatgtacgtggggcagctggagttcttcaacgggcaggcccccgacggcgtgaagagcttcggcagcgcgctgtgcatggcgtccatctcgctggggaactacgtgagcatcatgctggtgagcgtggtcaccagcctcaccgccggggagaggcggcccgggtggatcccggggaacctcaactccggccacctcgacaggttctacttcctcctcgccgcgctctcgctagtggacctcgccgtgtacgtcgcgtgcgcgacgtggtacaagggcatcaagctcgatggcggcggcgagacgaggaagaaccccgcgcacgtttaaacactgggcctgggccgttcttttgggtgttctggtttggagacgtgccgtgctggcccgtagaaaataaaatgtcaaagaactggcatgtggtccgtgttggatggcctattttgttctgtgtctttggtctagctccaagaatcagtctcagaactccatgtaatgctgctatgtatgtaaatataataaatatagtatatgtatggatgtctgctgaacttgcatgcagccaacctgtcaaagacagacttttttgtgtgtgatcg

SEQ ID NO: 216 - protein, 583 aa, Panicum virgatum
  misc_feature (1)..(583): Ceres Clone ID no. 1844568
  misc_feature (1)..(583): Bit score of 1022.5 for HMM based on sequences of Figure 6
  misc_feature (1)..(583): Functional Homolog Of SEQ ID NO. 209
  misc_feature (1)..(583): in Figure 6
  misc_feature (103)..(503): Pfam Name: PTR2 Pfam Description: POT family
MDPTTVESKWVSPTTEDGSMDRRGNPAAKAASGRWRSAILLLANYGLVTCAFFGVGVNLVVFLRRVLHQDNAEAANNISKWTGTVYIFSLIGAFLSDSYWGRYVTCAIFQIIYVTGLVILSLASWFLLVKPSGCGGVDARCDEPSAPGVALFYLSTYMIAFGNGGYQPSIATFGSDQFDETDPKEARSKVAFFSYFYLALNVGSLFSNTVLVYYEDSGRWVMGFWVSAAAAALALVLFLLGTPNYRHFKPSGNPLTRVAQVFVAALRKWHAEVPREEFLHEVEGEDPKVSGIRKILHSDELRFLDRAATVTEEEYGAPEKMKDPWRLCTVTQVEEVKCILKMLPIWLCTIVYSVVFTQMASLFVEQGATMNTNIGSFHFPAASMSLFDILSVLAFIAIYRRVLVPVMARLSGNPQGLTELQRMGVGLVIGMAAMVVAGAVEVERLRRVAAPDQPSSLSVLWQVPQYALIGASEVFMYVGQLEFFNGQAPDGVKSFGSALCMASISLGNYVSIMLVSVVTSLTAGERRPGWIPGNLNSGHLDRFYFLLAALSLVDLAVYVACATWYKGIKLDGGGETRKNPAHV

SEQ ID NO: 217 - DNA, 2101 bp, Triticum aestivum
  misc_feature (1)..(2101): Ceres Clone ID no. 797829
  misc_feature (1)..(2101): Encodes the peptide sequence at SEQ ID NO. 218
tacggagtgacagatacagaccgggcgtgcgagggagggaggaagggagctcggaggaagcagagggatcccatccgctccggcggtgccaggaagctgttcctctgagccgctgcagcgcgtagcctgactgagcagcgagagacaagcagcaaggtcagcagccatgggggaggtcgcggcggagctgtacacccaggatggcaccatcgacatcaagggcaacccggccctcaagaaggacaccggcaactggcgcgcatgcccctacatcctcgcgaacgagtgctgcgagcggctggcctattacggcatgagcaccaacctcgtcaacttcatgaaggaccggatgggcatggccaacgccgccgccgccaacaacgtcaccaactggggcggcacctgctacatcacgccgctcatcggcgccttcctcgccgacgcctacctcggccgcttctggaccatcgcctccttcatgatcatctacatcttcggcctcggcctgctcaccatggccacctccgtgcacggcctcgtgcccgcctgcgcctccaagggcgtctgcgaccccacgccgggccagtcggcggcggtcttcatcgcgctctacctcatcgcgctcggcaccggcgggatcaagccatgcgtgtcgtcgttcggggccgaccagttcgacgagcacgacgacgtggagcgcaagagcaagagctcgtttttcaattggttctacttctccatcaacatcggcgcgctggtggcctcgtccgtcctggtgtacgtgcagacgcatgtcgggtggagctggggcttcggcatccccgccgtcgtcatggccatcgccgtcggcagcttcttcgtcggcacgccgctctacaggcaccagcgccccggcggcagcccgctcacccgcatcgcgcaggtgctcgtcgccgccacgcgcaagctcggcgtccccgtcgacgggtcggcgctgtacgagaccgcggacagggagtccggcatcgagggcagccgcaagctggagcacacggagcagttcaggttcctcgacaaggcggccgtggagacgcaggcggacaagacggccaccgggccgtcgccgtggcggctgtgcacggtgacgcaggtggaggagctcaagagcgtggtgcggctgctgcccatctgggcgagcggcatcgtcttcgccacggtgtacgggcagatgagcaccatgttcgtgctgcagggcaacaccctggacgcctccatggggcccaagttcaagatcccctccgcctccctctccatcttcgacaccctcagcgtcatcgcctgggtgcccgtctacgaccgcatcctcgtccccgccgtgcgctccgtcaccggccggccccgcggcttcacccagctccagcgcatgggcatcggcctcgtcgtctccatgttcgccatgctcgccgccggcgtgctcgagctcgttcgcctccgcaccatcgcgcagcgcggcctctacggggagcacgacgtcgtgcccatctccatcttctggcaggtgccgcagtacttcatcatcggcgccgccgaggtgttcaccttcgtgggccagctcgagttcttctacgaccaggcgcccgacgccatgaggagcatgtgctccgcgctctccctcaccaccgtcgccctcgggaactacctcagcacgctcctcgtcaccgtcgtggccaagctcaccaccaggggaggcaagcaagggtggatccccgacaacctcaacgtcggccacctcgactacttcttctggctgctcgccgccctcagcctcctcaacttcgccgtctacctcctcatcgccagctggtacacctacaagaagaccgccggagatgatcacccagacgccatagccaaagggggagctcatgattgatgcacatgaccagtaaataagtgagtgactatgtctgcggttggtgtatgaatgttgaaagcagaagaagaaagcaaggattgagagttcggataggtgaaattaagggaggacaatgaaatgcatggtgtgatttgtgacttcaagattcaggagtgctgccttgttgattaatatactagtgtcttg

SEQ ID NO: 218 - protein, 581 aa, Triticum aestivum
  misc_feature (1)..(581): Ceres Clone ID no. 797829
  misc_feature (1)..(581): Bit score of 933.1 for HMM based on sequences of Figure 6
  misc_feature (1)..(581): Functional Homolog Of SEQ ID NO. 209
  misc_feature (1)..(581): in Figure 6
  misc_feature (98)..(498): Pfam Name: PTR2 Pfam Description: POT family
MGEVAAELYTQDGTIDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTPLYRHQRPGGSPLTRIAQVLVAATRKLGVPVDGSALYETADRESGIEGSRKLEHTEQFRFLDKAAVETQADKTATGPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQRGLYGEHDVVPISIFWQVPQYFIIGAAEVFTFVGQLEFFYDQAPDAMRSMCSALSLTTVALGNYLSTLLVTVVAKLTTRGGKQGWIPDNLNVGHLDYFFWLLAALSLLNFAVYLLIASWYTYKKTAGDDHPDAIAKGGAHD

SEQ ID NO: 219 - protein, 591 aa, Physcomitrella patens
  misc_feature (1)..(591): Public GI ID no. 168033816
  misc_feature (1)..(591): Physcomitrella patens subsp. patens
  misc_feature (1)..(591): Bit score of 943.4 for HMM based on sequences of Figure 6
  misc_feature (1)..(591): Functional Homolog Of SEQ ID NO. 209
  misc_feature (1)..(591): in Figure 6
  misc_feature (101)..(506): Pfam Name: PTR2 Pfam Description: POT family
MNAVGGAPDSEYPQDGTVDLRGNPVLKANTGGWKACPYILGNECCERLAYYGIATNLVTYLSHELHQNPSTAANNVTNWSGTCYITTLIGAFLADAYLGRFWTIVVFSIIYFLGMVLLTLSAALPSLKPPSGEGVVASSTQLAVFYLALYLIALGTGGIKPCVSSFGADQFDENDVKEKKRKSSFFNWFYFTINIGALIASSALVYIQENVGWGWGFGIPAVAMGIAIVSFLIGSPLYRHQKPGGSPITRIAQVLVAATRKLSMKVQPNGKHLYEADDKESGIEGSRKLEHTEEFRFLDKAAIPRGDEELQGTRPSGWRLTSVTQVEEVKIVMRLLPIWASGIVFATVYSQMSTMFVQQGALMNVSMGKANIPSASLSIFDTISVIVCVVIYDRFLVPVVRKRTGHVRGFTQLQRMGIGLFISVLAMVVAAIVEIERLKLARRDGVAGNPQDEALPVESLTIFVQIPQYFLIGAAEVFTFVGQLEFFYDQAPDAMRSLMSALSLTTVALGNYLSSVLVTIVTEVTTKGGKPGWIPNNLNRGHLDYFFWMLAILSILNIIFYLVVAKFYTYKRVHNAADVGEDGKPSKSGYE

SEQ ID NO: 220 - protein, 594 aa, Picea sitchensis
  misc_feature (1)..(594): Public GI ID no. 116788004
  misc_feature (1)..(594): Bit score of 984.9 for HMM based on sequences of Figure 6
  misc_feature (1)..(594): Functional Homolog Of SEQ ID NO. 209
  misc_feature (1)..(594): in Figure 6
  misc_feature (121)..(526): Pfam Name: PTR2 Pfam Description: POT family
MGVEGEGSVETALLEEGSISSVQTGKASEDEYTGDGSVDFWGRPSVKENTGNWRACPFILGNECCERLAYYGINTNLVTYLTKRLHQGNAAAAKSVTTWAGTCYLTPLFGAVLADAYWGRYWTIAAFSTIYFIGMATLTLSASVSSLKPPSCIGSDCPTANLAQYGVFFLGLYLIALGTGGIKPCVSSFGADQFDDTDPKEKKKKGSFFNWFYFSINVGALVSSSVLVWVQDNVGWGWGFGIPTLFMGLAIGSFFSGTPLYRLQKPGGSPVTRMCQVVVASLRKLRKTVPLDHSHLYEVQDRNSAIQGSRKLEHTDEFKCLDKSAIITDDDVRKGGFSNPWRLCTVTQVEEMKILLRMFPIWATGIVFAAVYSQISTMFVEQGMTLDTSIGSRFHIPPASLSVFDVVSVMIWVPVYDRVIVPIVSKYTKRERGFTELQRMGIGLFISILAMVAAALVEIRRLNIVKTYDLVYDKGTPVPMSIFWQIPQYFLVGASEVFTFVGQLEFFYDQSPDAMRSLCSALSLLTTALGNYLSSLIVTIVMFATTKGGNIGWIPDNLNEGHLDYYFWVLASLSVLNLLVYVSCAHRYKYKKAS

SEQ ID NO: 221 - protein, 583 aa, Hakea actites
  misc_feature (1)..(583): Public GI ID no. 149900503
  misc_feature (1)..(583): Bit score of 987.9 for HMM based on sequences of Figure 6
  misc_feature (1)..(583): Functional Homolog Of SEQ ID NO. 209
  misc_feature (1)..(583): in Figure 6
  misc_feature (112)..(515): Pfam Name: PTR2 Pfam Description: POT family
MGSLEERLLVEDEPVKNDGIGLYTGDGSVDIDGKPVLKENTGKWRACPFILGTECCERLAYYGIATNLVTYLTSKLHEGNASAARNVTTWSGTCYLAPLIGAVLADSYWGRYWTIAVFSIIYFIGMGTLTLSASVAAFKPSPCVGSVCPAATPAQYAVFFCGLYLIALGTGGIKPCVSSFGADQFDDTDPVERVQKGSFFNWFYFSINIGALISSSFLVWIQDNAGWGLGFGIPTLFMGVAIISFFSGTPLYRFQKPGGSPLMRMCQVFVASFRKWNLDVPQDSSLLFELPDKTSAIEGSRKLEHSDELRCLDKAAVVSDLDVQQGDLTNPWRLCTVTQVEELKILIRMFPIWATGIVFSAVYAQMSTMFVEQGMVLDTTIGSFTIPPASLSTFDVLSVIVWVPMYDRLLVPLARKFTGKERGFSELQRMGIGLFISILSMTAAAIVEIRRLQIAKSLGLVDQNVAVPMSILWQIPQYFLVGASEIFTFIGQLEFFYDQSPDAMRSLCSALSLLTTALGNYLSSFILTMVTTITTRGGKPGWIPDNLNEGHLDYFFWLLAGLSFLNLVIYVFCAARYKCKKAS

SEQ ID NO: 222 - protein, 580 aa, Solanum lycopersicum
  misc_feature (1)..(580): Public GI ID no. 4102839
  misc_feature (1)..(580): Bit score of 982.4 for HMM based on sequences of Figure 6
  misc_feature (1)..(580): Functional Homolog Of SEQ ID NO. 209
  misc_feature (1)..(580): in Figure 6
  misc_feature (109)..(512): Pfam Name: PTR2 Pfam Description: POT family
MKYLFSKNGGLLEDENSGLYTRDGSVDIKGNPVLKSETGNWRACPFILGNECCERLAYYGIAANLVTYLTKKLHEGNVSAARNVTTWQGTCYITPLIGAVLADAYWGRYWTIATFSTIYFIGMCTLTLSASVPAFKPPQCVGSVCPSASPAQYAIFFFGLYLIALGTGGIKPCVSSFGADQFDDTDPKERVKKGSFFNWFYFSINIGALISSSLIVWIQENAGWGLGFGIPAVFMGIAIASFFFGTPLYRFQKPGGSPLTRMCQVLVAVFHKWNLSVPDDSTLLYETPDKSSAIEGSRKLLHTDELRCLDKAAVVSDNELTTGDYSNAWRLCTVTQVEELKILIRMFPIWATGIVFSAVYAQMSTMFVEQGMVMDTAVGSFKIPAASLSTFDTISVIVWVPVYDKILVPIARRFTGIERGFSELQRMGIGLFLSMLCMSAAAIVEIRRLQLARDLGLVDEAVSVPLSIFWQIPQYFILGAAEIFTFIGQLEFFYDQSPDAMRSLCSALSLLTTALGNYLSSFILTVVTSITTRGGKPGWIPNNLNGGHLDYFFWLLAALSFFNLVIYVFLCQMYKSKKAS

SEQ ID NO: 223 - protein, 584 aa, Vicia faba
  misc_feature (1)..(584): Public GI ID no. 31088360
  misc_feature (1)..(584): Bit score of 960.2 for HMM based on sequences of Figure 6
  misc_feature (1)..(584): Functional Homolog Of SEQ ID NO. 209
  misc_feature (1)..(584): in Figure 6
  misc_feature (114)..(517): Pfam Name: PTR2 Pfam Description: POT family
MGSVEDDSSRLEEALIQDEESKLYTGDGSVDFKGRPVLKKNTGNWKACPFILGNECCERLAYYGIATNLVKPILLAKLHEGNVSAARNVTTWQGTCYLAPLIGAVLADSYWGRYWTIAIFSMIYFIGMGTLTLSASIPALKPAECLGAVCPPATPAQYAVFFIGLYLIALGTGGIKPCVSSFGADQFDDTDSRERVKKGSFFNWFYFSINIGALISSSFIVWIQENAGWGLGFGIPALFMGLAIGSFFLGTPLYRFQKPGGSPLTRMCQVVAASFRKRNLTVPEDSSLLYETPDKSSAIEGSRKLQHSDELRCLDRAAVISDDERKRGDYSNLWRLCTVTQVEELKILIRMFPVWATGIVFSAVYAQMSTMFVEQGTMMDTSVGSFKIPAASLSTFDVISVIFWVPVYDRFIVPIARKFTGKERGFSELQRMGIGLFISVLCMSAAAIVEIKRLQLAKELDLVDKAVPVPLTIFLQIPQYFLLGAAEVFTFVGQLEFFYDQSPDAMRSLCSALSLLTTSLGNYLSSFILTVVLYFTTRGGNPGWIPDNLNKGHLDYFSGLAGLSFLNMFLYIVAAKRYKSKKAS

SEQ ID NO: 224 - DNA, 1821 bp, Sorghum bicolor
  misc_feature (1)..(1821): Ceres Annot ID no. 8681236
  misc_feature (1)..(1821): Encodes the peptide sequence at SEQ ID NO. 225
atgaagatgagggcgatcgtcgtggaaggaggggagatgagcgcgccgacgccgacgccgaagcaggacaagtgctgcgagtacacgctcgacggctccgtcgacatcaagggccgcccggcggtcaaggggaaatcaggaggatggcttgccggtgctctaatccttgtgaaccagggcctggcgacactagccttcttcggcgtgaacgtgaacctggtgctgttcctgacgcgggtgctggggcagagcaacgaagacgccgccaacaacgtcagcaagtggacgggcaccgtgtacatgttctccctcatcggcgccttcctcagcgactcctactggggacgctacaagacctgcgccatcttccaggccatctttgtgctcggcctcgcgctgctgtcggtgtcgtcgcacctctacctaatcaggccggacgggtgcggcatggagcacgcgccctgcggcccgcactccggcaaggagctggggatcttctacatcgcgctgtacatgatcgccttcggcaacggcgggtaccagcccaacatcgccaccctgggcgccgaccagttcgacgaggacgaccccgccgaggcgcactccaaggtctccttcttcagctacttctacctcgccctcaacctcggctcgctcttctccaacaccttcctcagctacctcgaggacaagggcagctgggcgctcggcttctgggcctccaccgccgccgccgccaccgcgctcctgcttttcctcagcgggacgctccggtatcgctatttccagcccggagggaacccgatcgggaggatttgccaggtcgccatcgccgcgtccaggaaatggaaggcgggcgcgtcgaccaccggagtggtcagcctgtacgagggcgacgagaaggcggatgccgccggtggcaggaagcttttgcacacgcaagggttcagtttcttggaccgcgcggcgcacgctgacacggactccaagctcggcgcgcgcgacccctggaagctgtgcacggtgacgcaggtggaggaggtcaagagcatcctgaggctcctccccatctggctctgcaccatcctctactcggtcgtcttcacccagatggcctcgctctttgtcgtgcagggcgccgcgatgcgccgcaccaccccgttctccggcttctccgtcccgccctccagcatgtcggccttcgacatcctcgccgtcgccaccacgatcttcttgtaccgccgcgccatctgcccgttcctggcgcggctcaccggccgcccggccggccccaccgagctgcagaggatgggcctcggcctggtcgtgggtgccctggccatggccacggccgggacggtcgagcacttccggaaggccagggccaccgcggcgatgagcagcgacctgcatatcatgtggcaggtgccgcagtacgcgctgatcggcgtgtcggaggtgatgatgtacgtcgggcagctcgagttcttcaacggccagatgcccgacgggctcaaaagcttcgggagcgcgctctgcatgatgtccatgtcgctcggcaactacttcagtgacgtcatcgtgagcgcggtcaccaggctcaccacgacgcgagggcggtccgggtggatcccggctgacctcaacgagggccacctcgacaagttctacttcctgctcgccgtgctggccgtcgcggacttcgcggtgtacctcgtgtgcgcgagccgctacgggagcggcaaggtggacgggaggagcagcgacgacgaggaggagggagcggccggtcaggtgacatccctgccggcttacgcatga

SEQ ID NO: 225 - protein, 606 aa, Sorghum bicolor
  misc_feature (1)..(606): Ceres Annot ID no. 8681236
  misc_feature (1)..(606): Bit score of 967.3 for HMM based on sequences of Figure 6
  misc_feature (1)..(606): Functional Homolog Of SEQ ID NO. 209
  misc_feature (1)..(606): in Figure 6
  misc_feature (117)..(515): Pfam Name: PTR2 Pfam Description: POT family
MKMRAIVVEGGEMSAPTPTPKQDKCCEYTLDGSVDIKGRPAVKGKSGGWLAGALILVNQGLATLAFFGVNVNLVLFLTRVLGQSNEDAANNVSKWTGTVYMFSLIGAFLSDSYWGRYKTCAIFQAIFVLGLALLSVSSHLYLIRPDGCGMEHAPCGPHSGKELGIFYIALYMIAFGNGGYQPNIATLGADQFDEDDPAEAHSKVSFFSYFYLALNLGSLFSNTFLSYLEDKGSWALGFWASTAAAATALLLFLSGTLRYRYFQPGGNPIGRICQVAIAASRKWKAGASTTGVVSLYEGDEKADAAGGRKLLHTQGFSFLDRAAHADTDSKLGARDPWKLCTVTQVEEVKSILRLLPIWLCTILYSVVFTQMASLFVVQGAAMRRTTPFSGFSVPPSSMSAFDILAVATTIFLYRRAICPFLARLTGRPAGPTELQRMGLGLVVGALAMATAGTVEHFRKARATAAMSSDLHIMWQVPQYALIGVSEVMMYVGQLEFFNGQMPDGLKSFGSALCMMSMSLGNYFSDVIVSAVTRLTTTRGRSGWIPADLNEGHLDKFYFLLAVLAVADFAVYLVCASRYGSGKVDGRSSDDEEEGAAGQVTSLPAYA

SEQ ID NO: 226 - DNA, 1779 bp, Glycine max
  misc_feature (1)..(1779): Ceres Annot ID no. 8519531
  misc_feature (1)..(1779): Encodes the peptide sequence at SEQ ID NO. 227
atggaaccaggaatttgcaattctgtcaactccgtaaatgttgaagcaaccgagaaaaaggtgacaggaggaaatggaagctacacagagcagtcagacacaagctataagaagattaaaggaggttggaaaactgcaattatcttgttagcgaatcaagcactggctacactagctttctttggagttggagtgaacttggttctgtttctgacccgagtccttcgccaagacagtgctgaggctgctaacaatgtcagcaagtggaccggaactgtttacatattttcactcattggagccttcctcagtgattcttactggggacgatatttaacctgcgcaatctttcagttcatttttgttgtgggcttggggatgttgtcattgtcgtcttggcggtttttgatcaaaccggttggttgcggcaatgaagaaactacatgcttggaaccatcatcagtgggtgttggcattttctacttgtccatatatctagtggcatttggatatggagggcaccaacccaccttagcaacctttggtgcagatcaatttgacgagaagaacgaaaaacaaaagaacgcgagagaagctttcttctcttatttttactttgccctcaatgttggatctctgttctccaacactatattagtatactacgaggattcaggaatgtggacaatgggtttcttggtgtccttggcctcagctgttattgccttagtttcatacttagcaggatatcgaaaatatagatatgtaaagggatatgggaatccggtgataagggtagttcaggtgtttgtggccactgttagaaagtggaaggttggtccagccaaggaacaccaactttatgaggttgatggtccagaatctgccataaaagggagtagaaagattcatcacagcaatgattttagattcatggacaaggcagcaacaataacggagaaagatgcagttaatctcaagaatcactggcggctatgtactgtaactcaagttgaggaagccaaatgcgtactgagaatgctaccagtttggctatgtactataatttattcagttgtgtttacgcaaatggcttctctttttgtcgagcaaggggatgtgatgaacaacaagataggaaattttcacttgccagcagccagcatgtcagtgtttgatatctgcagtgtccttttatgcactggaatttatcgccaaatccttgttcctctagcaggaagatttagtggcaatcctaggggactaactgagcttcaaagaatgggagttggcctaattattggaatgttagctattcttgcagctggtgccacagagtttgaaaggctcaaacacattacacccggggaaaaggctagttctttgagtatattttggcaaatcccacagtatgttctagttggtgcttcagaagttttcatgtatgtgggtcaactggagttctttaatgggcaagccccagatggcataaaaagctttgggagctcactttgcatggcttcaatttctcttggaaactatgtgagtagcttgctggtgtacatggtgatgggaatcactgcaagaggcgagaatccgggatggattcccaataacttgaatgtggggcacatggataggtttttcttcctcgttgcagtgctaactgctcttgattttgtactctacttattatgtgctcgctggtacaagagcatcaaccttggagatggtgacatgggaagccaagaggacgaggaagtgatcagtaaagtttga

SEQ ID NO: 227 - protein, 592 aa, Glycine max
  misc_feature (1)..(592): Ceres Annot ID no. 8519531
  misc_feature (1)..(592): Bit score of 961.6 for HMM based on sequences of Figure 6
  misc_feature (1)..(592): Functional Homolog Of SEQ ID NO. 209
  misc_feature (1)..(592): in Figure 6
  misc_feature (113)..(508): Pfam Name: PTR2 Pfam Description: POT family
MEPGICNSVNSVNVEATEKKVTGGNGSYTEQSDTSYKKIKGGWKTAIILLANQALATLAFFGVGVNLVLFLTRVLRQDSAEAANNVSKWTGTVYIFSLIGAFLSDSYWGRYLTCAIFQFIFVVGLGMLSLSSWRFLIKPVGCGNEETTCLEPSSVGVGIFYLSIYLVAFGYGGHQPTLATFGADQFDEKNEKQKNAREAFFSYFYFALNVGSLFSNTILVYYEDSGMWTMGFLVSLASAVIALVSYLAGYRKYRYVKGYGNPVIRVVQVFVATVRKWKVGPAKEHQLYEVDGPESAIKGSRKIHHSNDFRFMDKAATITEKDAVNLKNHWRLCTVTQVEEAKCVLRMLPVWLCTIIYSVVFTQMASLFVEQGDVMNNKIGNFHLPAASMSVFDICSVLLCTGIYRQILVPLAGRFSGNPRGLTELQRMGVGLIIGMLAILAAGATEFERLKHITPGEKASSLSIFWQIPQYVLVGASEVFMYVGQLEFFNGQAPDGIKSFGSSLCMASISLGNYVSSLLVYMVMGITARGENPGWIPNNLNVGHMDRFFFLVAVLTALDFVLYLLCARWYKSINLGDGDMGSQEDEEVISKV

SEQ ID NO: 228 - DNA, 1749 bp, Zea mays
  misc_feature (1)..(1749): Ceres Annot ID no. 8631372
  misc_feature (1)..(1749): Encodes the peptide sequence at SEQ ID NO. 229
atggatgctaccactgttgattccaaatggatctctcccgccactgaagatgggtccatggacaggcgaggaaacccagctgtcaagacaaccaccggaagatggagatctgccatcctgctgctagctaactatgggctcgcgacgtgcgccttcttcggcgtcggcgtgaacctcgtggtgttcctgcgccgggtgctccaccagggcaacgccgaggcggccaacagcatcagcaagtggactgggaccgtctacatcttctcgctcatcggcgccttcctcagcgactcctactggggccgatacgtcacgtgcgccgtcttccagatcatctacgtgatggggctggtggtcctgtcgctcgcgtcatggctcttgctggtgaagccgtccggctgcggcggcgtcaaggcgcactgcgacgggccgtcggcgcccggcgtcgcgctgttctacctgtccacctacatgatcgcgttcggcaacggagggtaccagccttccatcgcgacgttcgggtcggaccagttcgacgagacggaccccgaggaggcgcgctccaaggtggccttcttcagctacttctacctggcgctcaacgtcggctccctgctctccaacacggtgctggtgtactacgaggactcggggcggtgggtcatggggttctgggtctcggcggccgccgcggcgctggcgctcgtgctcttcctgctcggcacgcccggctaccgccacttcaagccgagcggcaacccgctcacccgcgtcgcgcaggtgttcgtcgccgcgctgcgcaagtggcgcgccgaggtcccgcgtggcgagctcctccacgaggtggtggaagcaggagaggaccctaaggtctcgggcatccgcaagatccttcacagcgacgggctcaggttcctcgacaaggcggcgacgatcacggaggaggaggaggaggagggtccgtggcggctctgcacggtgacgcaggtggaggaggtgaagtgcatcctgaggatgctgcccatctggctgtgcacgatcgtgtactcggtggtgttcacccagatggcgtcgctgttcgtggagcagggcgccaccatggacaccaacatcgggtcgttccacttccccgccgcgagcatgtcgctgttcgacgtcctcagcgtgctggcgttcatcgccatctaccggcgggtgctggtgcccgtcatggcgcggctgtcaggcaacccgcagggcctgaccgagctgcagcgcatgggcgtcgggctcgtgatcggcatggcggcgatggtggtggcgggcgtggtggaggtggagcggctgaagcgcgtggcggccccggaccagccgagctccctgagcgtgctgtggcaggtgccgcagtacgcgctgatcggggcgtcggaggtgttcatgtacgtggggcagctggagttcttcaacgggcaggcgcccgacggcgtcaagagcttcggcagcgcgctgtgcatggcgtccatctcgctggggaactacgtgagcatcatgctggtgagcgtagtcacgagcctcaccgccggtgagaagcgtccggggtggatccctgggaaccttaactcaggacacctcgacaggttctacttcctcctcgccgctctctcgctcgtggacctcgccgtctacgtcgcctgtgccatgtggtacaagggcatcaagcttgacggcggcgacggcgataacaggagaaaggtctctgcgcacgtctag

SEQ ID NO: 229 - protein, 582 aa, Zea mays
  misc_feature (1)..(582): Ceres Annot ID no. 8631372
  misc_feature (1)..(582): Bit score of 1010.0 for HMM based on sequences of Figure 6
  misc_feature (1)..(582): Functional Homolog Of SEQ ID NO. 209
  misc_feature (1)..(582): in Figure 6
  misc_feature (103)..(500): Pfam Name: PTR2 Pfam Description: POT family
MDATTVDSKWISPATEDGSMDRRGNPAVKTTTGRWRSAILLLANYGLATCAFFGVGVNLVVFLRRVLHQGNAEAANSISKWTGTVYIFSLIGAFLSDSYWGRYVTCAVFQIIYVMGLVVLSLASWLLLVKPSGCGGVKAHCDGPSAPGVALFYLSTYMIAFGNGGYQPSIATFGSDQFDETDPEEARSKVAFFSYFYLALNVGSLLSNTVLVYYEDSGRWVMGFWVSAAAAALALVLFLLGTPGYRHFKPSGNPLTRVAQVFVAALRKWRAEVPRGELLHEVVEAGEDPKVSGIRKILHSDGLRFLDKAATITEEEEEEGPWRLCTVTQVEEVKCILRMLPIWLCTIVYSVVFTQMASLFVEQGATMDTNIGSFHFPAASMSLFDVLSVLAFIAIYRRVLVPVMARLSGNPQGLTELQRMGVGLVIGMAAMVVAGVVEVERLKRVAAPDQPSSLSVLWQVPQYALIGASEVFMYVGQLEFFNGQAPDGVKSFGSALCMASISLGNYVSIMLVSVVTSLTAGEKRPGWIPGNLNSGHLDRFYFLLAALSLVDLAVYVACAMWYKGIKLDGGDGDNRRKVSAHV

SEQ ID NO: 230 - protein, 614 aa, Hordeum vulgare
  misc_feature (1)..(614): Public GI ID no. 151426449
  misc_feature (1)..(614): Bit score of 969.4 for HMM based on sequences of Figure 6
  misc_feature (1)..(614): Functional Homolog Of SEQ ID NO. 209
  misc_feature (1)..(614): in Figure 6
  misc_feature (122)..(525): Pfam Name: PTR2 Pfam Description: POT family
MSANEGDLKMRVIAMGGEAASERRAAEEKLCEYTLDGSVDIKGRPAVKGKSGGWLAGGLILVNQGLATMAFFGVNVNLVLFLTRLVQQSNGDAANNVSKWTGTVYMFSLIGAFLSDSYWGRYKTCAIFQAIFVLGLGLLSLSSRLYLIRPVGCGTEHTPCASHSGTEMGIFYIALYMIAFGNGGYQPNIATFGADQFDEEDPAEAHSKVSFFSYFYMALNLGSLFSNTFLSYLQDHGKWVLGFWASTAAAATALLLFLSGTPQYRHAQPCGNPMASICQVASAACRNWKSGGVSPDVEILYEGDDKTDSGSRKLLHTKGFRFLDRAALTTEDTNSKLATCSKTRDQWRLCTVTQVEQVKSILRILPIWVCTILYSVVFTQMASLFVVQGAAMRRTTPLGSFSIPASSMSAFDILTVTTTIFLYRRAICPLLARLTGRPTGPTELQRMGLGLVLGAMAMANAGTVEHFRKASATTANGSELHILWQVPQYALIGVSEVMMYVGQLEFFNGEMPDGFKSFGSALCMMSMSLGNYFSDIIVSAVTKATAVDGRPGWIPADLNEGHLNKFYFLLAILSVADFAVYLVFAGRYRKSCKVEGRSDDEEEGSVDDEEACHA

SEQ ID NO: 231 - protein, 582 aa, Brassica rapa
  misc_feature (1)..(582): Public GI ID no. 192757675
  misc_feature (1)..(582): Bit score of 1003.1 for HMM based on sequences of Figure 6
  misc_feature (1)..(582): Functional Homolog Of SEQ ID NO. 209
  misc_feature (1)..(582): in Figure 6
  misc_feature (101)..(503): Pfam Name: PTR2 Pfam Description: POT family
MDQKVRHTEVCTQDGSVDRHGNPAIRAKTGKWLTAILILVNQGLATLAFFGVGVNLVLFLTRVMGQDNAEAANNVSKWTGTVYIFSLLGAFLSDSYWGRYKTCAIFQASFVAGLVMLSLSTGALLLEPSGCGVEESPCKPHSTVKTVIFYLSVYLIALGYGGYQPNIATFGSDQFDADDSVEGHSKIAFFSYFYLALNLGSLLSNTVLGYFEDQGAWPLGFWASAGSAFAGLVLFLAGTPKYRHFKPRESPWSRFCQVLVASTRKAKIDVNYDDMNLYDSETQRTGDKKILHTKGFRFLDRAAIVTPDDEAEKVESGSAYDPWRLCSVTQVEEVKCVLRLLPIWLCTILYSVVFTQMASLFVVQGAAMKTNIKDFRIPASSMSTFDILSVAFFIFAYRRFLDPLFARLNKTEPNKGLTELQRMGIGLVIAITAMISAGIVEIYRLKHKETASNSSSLSIFWQVPQYMMIGASEVFMYVGQLEFFNSQAPTGLKSFASALCMASISLGNYVSSLLVSIVMKISTRDDLPGWIPGNLNKGHLDRFYFLLAALTAADFVVYLVCAKWYKYIKSEASFSESIAEEE

SEQ ID NO: 232 - protein, 579 aa, Hordeum vulgare
  misc_feature (1)..(579): Public GI ID no. 2655098
  misc_feature (1)..(579): Hordeum vulgare subsp. vulgare
  misc_feature (1)..(579): Bit score of 926.3 for HMM based on sequences of Figure 6
  misc_feature (1)..(579): Functional Homolog Of SEQ ID NO. 209
  misc_feature (98)..(498): Pfam Name: PTR2 Pfam Description: POT family
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTSLYRHQRPGGSPLTRIAQVLVAATRKLGVAVDGSALYETADKESGIEGSRKLEHTRQFRFLDKAAVETHADRTAAAPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQHGLYGEKDVVPISIFWQVPQYFIIGCAEVFTFVGQLEFFYDQAPDAMRSMCSALSLTTVALGNYLSTLLVTVVAKVTTRGGKQGWIPDNLNVGHLDYFFWLLAALSLVNFAVYLLIASWYTYKKTAGDSPDAKGGAHDQ

SEQ ID NO: 233 - protein, 580 aa, Zea mays
  misc_feature (1)..(580): Public GI ID no. 194690746
  misc_feature (1)..(580): Bit score of 917.6 for HMM based on sequences of Figure 6
  misc_feature (1)..(580): Functional Homolog Of SEQ ID NO. 209
  misc_feature (97)..(498): Pfam Name: PTR2 Pfam Description: POT family
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESVIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 234 - DNA, 2186 bp, Triticum aestivum
  misc_feature (1)..(2186): Ceres Clone ID no. 752925
  misc_feature (1)..(2186): Encodes the peptide sequence at SEQ ID NO. 235
aaaggtggctgtggctcacacacacacacacacacacgcagagacaagagacaagagacagcgagtcagaccaggccatagggaatcccgcgcgcggggcgggcgacgactgaggcggagatcccttccggccggccgccgccgctcgtggacaccgaccaacataggaagcagcagttcctctgagccgctgccgctgcagtgcctagtctgactgagcggcgagaaagaagcaaggccagcagccatgggggaggtcgcggcggagatgtacacccaggatggcaccgtcgacatcaagggcaacccggccctcaagaaggacaccggcaactggcgcgcatgcccctacatcctcgcgaacgagtgctgcgagcggctggcctactatggcatgagcaccaacctggtcaacttcatgaaggaccggatgggcatggccaacgccgccgccgccaacaacgtcaccaactggggcggcacctgctacatcacgccgctcatcggcgccttcctcgccgacgcctacctcggccgcttctggaccatcgcctccttcatgatcatctacatcttcggcctcggcctgctcaccatggccacctccgtgcacggcctcgtgccgacctgcgccgccaagggcgtctgcgaccccacgccgggccagtcggcggccgtcttcatcgcgctctacctcatcgcgctcggcaccggcgggatcaagccctgcgtgtcgtcgttcggggcggaccagttcgacgagcacgacgacgtggagcgcaagagcaagagctccttcttcaactggttctacttctccatcaacatcggcgcgctggtggcctcgtccgtgctcgtgtacgtgcagacgcatgtcggctggagctggggcttcggcatccccgccgtcgtcatggccatcgccgtcggcagcttcttcgtcggcacgccgctctacaggcaccagcgccccggcggcagcccgctcacccgcatcgcgcaggtgctcgtcgccgccacgcgcaagctcggcgtcaccgtcgacgggtcggcgctgtacgagaccgcggacagggagtccggcatcgaggggagccgcaagctggagcacactgagcagttgaggttcctcgacaaggcggccgtcgagacgcaggcggacaagacggcggccaccgggccgtcgccgtggcggctgtgcaccgtgacgcaggtggaggagctcaagagcgtggtgcggctgctgcccatctgggcgagcggcatcgtcttcgccacggtgtatgggcagatgagcaccatgttcgtgctccagggaaacaccctggacgcctccattgggcccaagttcaagatcccctccgcctcgctctccatcttcgacaccctcagcgtcatcgcctgggtgcccgtctacgaccgcctcctcgtccccgccgtgcgctccgtcaccggccagccccgcggcttcacgcagctccagcgcatgggcatcggcctcctcgtctccatgttcgccatgctcgccgccggcgtgctcgagctcgtccgcctccgcaccatcgcgcagcgcggcctctacggcgagaaggacgtggtgcccatctccatcttctggcaggtgccgcagtacttcatcatcggcgccgccgaggtcttcaccttcgtgggccagctcgagttcttctacgaccaggcgcccgacgccatgaggagcatgtgctccgcgctctccctcaccaccgtcgcgctcgggaactacctcagcacgctgctcgtcaccgtcgtggccaagctcaccaccaggggaggcaagcaagggtggatccccgacaacctcaacgtcggccacctcgactacttcttctggctgctcgccgcgctcagcctcctcaacttcgccgtctacctcctcatcgccagctggtacacctacaagaagaccgccggagatgacacagacgccaaagccaaaggaggcgctgatgattgatgcaaatgaccagtgagtgagtgactctgcctggggttggtgtatgaatgttgaaagaggaagaagaaagcaaggattgagacttcagagttcagataggtgaaattaagggaggacaatgaaatgcatggtgtgatttgtgacttgaagattcaagagtgttgccttgttgatttatatactagtgtcttgg

SEQ ID NO: 235 - protein, 581 aa, Triticum aestivum
  misc_feature (1)..(581): Ceres Clone ID no. 752925
  misc_feature (1)..(581): Bit score of 932.7 for HMM based on sequences of Figure 6
  misc_feature (1)..(581): Functional Homolog Of SEQ ID NO. 209
  misc_feature (98)..(499): Pfam Name: PTR2 Pfam Description: POT family
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPTCAAKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTPLYRHQRPGGSPLTRIAQVLVAATRKLGVTVDGSALYETADRESGIEGSRKLEHTEQLRFLDKAAVETQADKTAATGPSPWRLCTVTQVEELKSVVRLLPIWASGIVFATVYGQMSTMFVLQGNTLDASIGPKFKIPSASLSIFDTLSVIAWVPVYDRLLVPAVRSVTGQPRGFTQLQRMGIGLLVSMFAMLAAGVLELVRLRTIAQRGLYGEKDVVPISIFWQVPQYFIIGAAEVFTFVGQLEFFYDQAPDAMRSMCSALSLTTVALGNYLSTLLVTVVAKLTTRGGKQGWIPDNLNVGHLDYFFWLLAALSLLNFAVYLLIASWYTYKKTAGDDTDAKAKGGADD

SEQ ID NO: 236 - protein, 574 aa, Oryza sativa
  misc_feature (1)..(574): Public GI ID no. 125540898
  misc_feature (1)..(574): Oryza sativa Indica Group
  misc_feature (1)..(574): Bit score of 994.7 for HMM based on sequences of Figure 6
  misc_feature (1)..(574): Functional Homolog Of SEQ ID NO. 209
  misc_feature (105)..(493): Pfam Name: PTR2 Pfam Description: POT family
MAPTAVDSKRISDITEDGSMDRRGNPAVKAKTGNWRSSILLLVNYGLVTCAFFGVGVNLVVFLRRVLHQDNAEAANSISKWTGTVYIFSLIGAFMSDSYWGRYITCAIFQMIYVTGLVILSLASWFLLVKPTGCGAAGEHCDAPSSAGVALFYLSTYMIAFGNGGYQPSIATFGSDQFDETDPREARSKVAFFSYFYLALNVGSLFSNTVLVYYEDEGRWVMGFWVSAAAAAMALVLFLLGTPNYRHFKPTGNPLTRIAQVFVAAFRKWRAEVPRSELLHEVDGDESQIAGIRKILHSDQIRFLDKAATVTEEDYCTPENMQDPWRLCTVTQVEEVKCILKMLPIWLCTIVYSVVFTQMASLFVEQGTTMNTNIGSFHVPAASMSVFDILSVLAFIAIYRRVLVPGLTELQRMGVGLVVGMAAMVVAGVVEVERLKRVGAPDQPSSLSVLWQVPQYALIGASEVFMYVGQLEFFNGQAPDGVKSFGSSLCMASISLGNYVSIMLVSVVTSLTAGDRRPGWIPGNLNSGHLDRFYFLLAALSLVDLAVYVACAVWYKGIKLDSNEEKANKITVHV

SEQ ID NO: 237 - protein, 589 aa, Arabidopsis thaliana
  misc_feature (1)..(589): Public GI ID no. 26451333
  misc_feature (1)..(589): Bit score of 1003.7 for HMM based on sequences of Figure 6
  misc_feature (1)..(589): Functional Homolog Of SEQ ID NO. 209
  misc_feature (101)..(508): Pfam Name: PTR2 Pfam Description: POT family
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILNVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 238 - protein, 568 aa, Arabidopsis thaliana
  misc_feature (1)..(568): Public GI ID no. 2160144
  misc_feature (1)..(568): Bit score of 821.6 for HMM based on sequences of Figure 6
  misc_feature (1)..(568): Functional Homolog Of SEQ ID NO. 209
  misc_feature (109)..(499): Pfam Name: PTR2 Pfam Description: POT family
MFKILTTKIQSFFCLNISGGTEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 239 - protein, 590 aa, Arabidopsis thaliana
  misc_feature (1)..(590): Public GI ID no. 30696666
  misc_feature (1)..(590): Bit score of 851.7 for HMM based on sequences of Figure 6
  misc_feature (1)..(590): Functional Homolog Of SEQ ID NO. 209
  misc_feature (124)..(521): Pfam Name: PTR2 Pfam Description: POT family
MVNSNEEDERRILDVEESLLTQEEVNNHLTGLSSTAEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDGYKFLDKAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 240 - protein, 561 aa, Oryza sativa
  misc_feature (1)..(561): Public GI ID no. 125556922
  misc_feature (1)..(561): Oryza sativa Indica Group
  misc_feature (1)..(561): Bit score of 792.5 for HMM based on sequences of Figure 6
  misc_feature (1)..(561): Functional Homolog Of SEQ ID NO. 209
  misc_feature (91)..(485): Pfam Name: PTR2 Pfam Description: POT family
MEATTTDGTTDHAGKPAVRSKSGTACPFILGNECCERLAYYGMSANLVNYMVDRLRQGNAGAAASVNNWSGTCYVMPLVGAFLADAYLGRYRTIAAFMALYIVGLALLTMSASVPGMKPPNCATISASSCGPSPGQSAAFFVALYLIALGTGGIKPCVSSFGADQFDDADPREHRSKASFFNWFYMSINVGALVASSVLVWVQMNVGWGWGFGIPAVAMAVAVASFLMGSSLYRHQKPGGSPLTRMLQVVVAAARKSRVALPADAAALLYEGDKLACGTRRLAHTEQFRWLDRAAVVTPTTDKDDDTGSRWRLCPVTQVEELKAVVRLLPVWASGIVMSAVYGQMSTMFVLQGNTLDPRMGATFKIPSASLSIFDTLAVLAWVPVYDRLIVPAARRFTGHPRGFTQLQRMGIGLLISVFSMVAAGVLEVVRLRVAAAHGMLDSTSYLPISIFWQVQYFIIGQIDFFYDQAPDDMRSTCTALSLTSSALGNYLSTLLVVIVTAASTRGGGLGWIPDNLNRGHLDYFFWLLAALSAVNFLVYLWIANWYRCKTITTTEAAAQT

SEQ ID NO: 241 - DNA, 1710 bp, Populus trichocarpa
  misc_feature (1)..(1710): Ceres Annot ID no. 1529287
  misc_feature (1)..(1710): Encodes the peptide sequence at SEQ ID NO. 242
atggcagaaactgattacacaaacaatgggacggtggatatcgaaggaaatccagctaataagaagaaaactggaaactggaagtcttgccgctttattcttgggaatgaatgctgtgagaggttggcatactacgggatgagtacgaatctagtgaactatcttggggaccgtctcaaccagggaaatgttgctgcagcaaacaatgtcaccaattggtctggaacttgctatgtcacaccactgattggagcctttctagcagattcatatttgggaagatattggacaattgcgagttttgttatcatatatatcattggaatgacactcctaacattgtctgcttcggtcactggtctgaagccatcatgtgataaggattcttgccacccgaccacaggacaaactgcagcatgctttgtagcactttacatgatcgctcttggaactggaggaatcaagccatgtgtttcatcctttggcgcagatcaatttgatgaaactgatgagaccgagaggaaaaagaaaagctccttttttaattggttttacctttcaatcaatatcggcgcgcttgttgcgtcttctgttttggtctggatacaaatgaatgttggctggggatgggggtttggagtcccagcagttgccatggctgtagcggttgtgtttttcttcttaggaagcaagctataccgaattcaaaaacctggtgggagtcccattacaaggattgtccaggttatagttgcatccttcagaaagagtaatgttcaagttcctgctgataaatctcttctttacgagactgcagaggaggaaagtcaaatccaaggaagccgcaagcttgaacataccaacaaattcaagttcttcgataaggctgctgtgaaaacccaagatgacaatataaagggcttaacaagtccatggagactctgcacagtaactcaagttgaagagctcaagtccataatcaggttgctcccagtatgggcatctggaatagtcttctcaactgtgtacagtcaaatgaacaccatgttcgttttgcaaggaaataccatggaccaacacatgggtccacatttccagattccatcagcatcgctctccctctttgatacccttagcgtcatcttctgggctcctgtatacgatcgaatcattgtcccatatgcaaggaaatttacgggtcatgaacgaggctttactcagctccaacgcatgggcattggcctcgtcatatcaattgtgtccatgatcactgctggaatattggaggttgttcggctcaactttgtccaaaagaacaattactatgatcttaagtacatcccaatgtccattttctggcaagtaccgcagtactttctcattggatgtgcagaagtttttaccttcattggacagttggagtttttctacgaccaggcaccagatgctatgagaagtttgtgctcagctctttcgcttaccactgtcgcattaggaaattacttgagcactctgcttgtcaccattgttactaaaatcacaacgagaggtgggaagctcggttggattcctgataatatgaacaggggccatcttgattacttctactggctcttggcaattctcagcttcctgaacttcattttgtatctctggatttcaaaatggtttacctacaagaaagctacagggcatcctcaacgagactga

SEQ ID NO: 242 - protein, 569 aa, Populus trichocarpa
  misc_feature (1)..(569): Ceres Annot ID no. 1529287
  misc_feature (1)..(569): Bit score of 905.5 for HMM based on sequences of Figure 6
  misc_feature (1)..(569): Functional Homolog Of SEQ ID NO. 209
  misc_feature (95)..(495): Pfam Name: PTR2 Pfam Description: POT family
MAETDYTNNGTVDIEGNPANKKKTGNWKSCRFILGNECCERLAYYGMSTNLVNYLGDRLNQGNVAAANNVTNWSGTCYVTPLIGAFLADSYLGRYWTIASFVIIYIIGMTLLTLSASVTGLKPSCDKDSCHPTTGQTAACFVALYMIALGTGGIKPCVSSFGADQFDETDETERKKKSSFFNWFYLSINIGALVASSVLVWIQMNVGWGWGFGVPAVAMAVAVVFFFLGSKLYRIQKPGGSPITRIVQVIVASFRKSNVQVPADKSLLYETAEEESQIQGSRKLEHTNKFKFFDKAAVKTQDDNIKGLTSPWRLCTVTQVEELKSIIRLLPVWASGIVFSTVYSQMNTMFVLQGNTMDQHMGPHFQIPSASLSLFDTLSVIFWAPVYDRIIVPYARKFTGHERGFTQLQRMGIGLVISIVSMITAGILEVVRLNFVQKNNYYDLKYIPMSIFWQVPQYFLIGCAEVFTFIGQLEFFYDQAPDAMRSLCSALSLTTVALGNYLSTLLVTIVTKITTRGGKLGWIPDNMNRGHLDYFYWLLAILSFLNFILYLWISKWFTYKKATGHPQRD

SEQ ID NO: 243 - DNA, 2248 bp, Panicum virgatum
  misc_feature (1)..(2248): Ceres Clone ID no. 1806748
  misc_feature (1)..(2248): Encodes the peptide sequence at SEQ ID NO. 244
gtggcgctcctcccggtcccggccgcctcctctcctctcttccctcgtctcgcggtcgcgcccagagccgagaggaggaacaggcagggagattccacgcgcccggcagttacgataccgcgccgcagattccctcgtcgctgctcccccaagccctcccgcaccagcagcgccgccgccctccgccgccggctctccagtccagtccaggataggaggcctctgactctctgagctgcacaccatctgagcgacgccatgggagaggtcgcagacatgtacacccaagacgggaccgtcgacatgaagggcaacccggccgtgaagaagggcaccggcaactggcgcgcctgcccttacatcctcgcgaacgagtgctgcgagaggctggcgtactacagcatgagcaccaacctggtgaactacatgaagacccgcctcggccaggggaactccgtcgccgccaacaacgtcaccaactggagcggaacgtgctacatcacgccactcatcggcgcattcttggctgacgcctacatggggagatactggaccatcgccagcttcatgatcatctacatcattggcctgacgctgctgacaatggcgtcgtcggtgaaggggctggtgccgtcgtgcgacggcagcgggacgtgccacccgacggagtcgcagtcggcggcggtgttcgtggcgctgtacctgatcgcgctgggcacgggcggcatcaagccctgcgtgtcgtccttcggcgccgaccagtttgacgagaacgacgagcgggagaacaagagcaagagctccttcttcaactggttctacttctccatcaacatcggcgcgctggtggcgtcgacggtgctggtgtacgtgcagacgcacgtcggctggggctggggctttggcatccccgccgtggtgatggccatcgccgtcgtgagcttcttcgtcggcacgccgctgtaccggcaccagcgccccgggggcagcccggtcacgcgcatcgcgcaggtgctcgtcgcgtccgcgcgcaagtggagcgtggccgtgcccgccgacaaggcgcagctgcacgagacgctggacaaggagtccggcatcgagggcagccgcaagctcgagcacacggaccagttccgctgcctcgacaaggcggccgtcgtgacggcccctgacggcgcggcggcggcggcgccgagcccgtggcggctgtgcacggtgacccaggtggaggagcttaagagcgtggtccggctgctgcccatctgggcgaccgggatcgtgttcgcgacggtgtacgggcagatgagcaccatgttcgtgctgcagggcaacacgctggaccagcgcatggggccccggttcagcatcccctcggcgacgctctccatggtggacaccatcagcgtcatcatctgggtgcccatctacgaccgcctcatcgtgcccgcggcgcgctccgtcacgggccgcccgcgcgggttcacgcagctgcagcgcatgggcatcggcctcgtcatctccatcttctccatggtcgccgcgggcgtgctcgacgtcgtgcggctgcgcgccgtggcgcggcacgggctgtatggcgacaaggacacggtgcccatctccatcttctggcagatcccgcagtacttcatcatcgggtgcgccgaggtgttcaccttcgtggggcagctcgagttcttctacgaccaggctcccgacgccatgaggagcctgtgctcggcgctgtcgctcaccaccgtggcgctgggcaactacctgagcacggtgctggtgaccatcgtgacgcgcatcaccaccaggcacggcaggctcgggtggatcccggacaacctcaaccgcggccacctcgactacttcttctggctgctcgccgtgctcagcctcctcaacttcctcgtctacctgctcatcgccaggtggtacaaatacaagaagacggcggaatacccggacgccaccaaaggggagcgcaaccaggaacactgatcaagcggtggtgcagggctacatacaggctgactggacggagaagaagaagaaaaccaagtgattaaattctctctgttcggttggcttccgatttgttcgtgggagttcgcgtgtttaaacgtactagttcactgtaggtgacaggggtcgaatggattgcttagtatgtcatgtgtcagtaatatgcgcaatgcttgatctcaaatatcagtagtatctataaaataagttcagctcc

SEQ ID NO: 244 - protein, 582 aa, Panicum virgatum
  misc_feature (1)..(582): Ceres Clone ID no. 1806748
  misc_feature (1)..(582): Bit score of 922.9 for HMM based on sequences of Figure 6
  misc_feature (1)..(582): Functional Homolog Of SEQ ID NO. 209
  misc_feature (97)..(500): Pfam Name: PTR2 Pfam Description: POT family
MGEVADMYTQDGTVDMKGNPAVKKGTGNWRACPYILANECCERLAYYSMSTNLVNYMKTRLGQGNSVAANNVTNWSGTCYITPLIGAFLADAYMGRYWTIASFMIIYIIGLTLLTMASSVKGLVPSCDGSGTCHPTESQSAAVFVALYLIALGTGGIKPCVSSFGADQFDENDERENKSKSSFFNWFYFSINIGALVASTVLVYVQTHVGWGWGFGIPAVVMAIAVVSFFVGTPLYRHQRPGGSPVTRIAQVLVASARKWSVAVPADKAQLHETLDKESGIEGSRKLEHTDQFRCLDKAAVVTAPDGAAAAAPSPWRLCTVTQVEELKSVVRLLPIWATGIVFATVYGQMSTMFVLQGNTLDQRMGPRFSIPSATLSMVDTISVIIWVPIYDRLIVPAARSVTGRPRGFTQLQRMGIGLVISIFSMVAAGVLDVVRLRAVARHGLYGDKDTVPISIFWQIPQYFIIGCAEVFTFVGQLEFFYDQAPDAMRSLCSALSLTTVALGNYLSTVLVTIVTRITTRHGRLGWIPDNLNRGHLDYFFWLLAVLSLLNFLVYLLIARWYKYKKTAEYPDATKGERNQEH

SEQ ID NO: 245 - DNA, 1794 bp, Glycine max
  misc_feature (1)..(1794): Ceres Annot ID no. 8755095
  misc_feature (1)..(1794): Encodes the peptide sequence at SEQ ID NO. 246
atggcctgcttagaagtcagcaaagagggaaagttcaaaggtgacacagaagaactcactcttgatggaagtgttgattggcatggtcgcccagcaatcagagccaaatctggcagatgggttgctggaaccatcgttctattgaaccaaggtctggcaaccttagcattctttggagtaggggttaacctagtgctgttcctgacaagagtgatggggcaaaataatgctgcagctgcaaacagtgtgagcaaatggactggcacagtttacatcttctctctagtgggtgctttcctaagtgattcttattggggaagatacaaaacttgtgccatctttcaggtcatctttgtaataggtctagtatcattgtccctttcatcatacctctccttgattaggcctaaaggttgtgggaatgaaacaattccatgtgggaagcattcaagcttggagatggggatgttctacctctcaatttatctcattgctttagggaatggagggtatcagccaaatattgccacatttggagctgaccagtttgacgaggagcactcaaaggagggttactcaaaggttgccttctttagctacttctacctggctttgaaccttggttcactcttctcaaacacaattctaggctattttgaagatgaaggactgtgggctctagggttctgggtgtctgcaggctctgcttttgccgcccttgtcttgtttcttcttgggaccccacgatatagacacttcaaacccagtggcaatcctctttcaaggttcagccaagtccttgttgctgcatcaaggaaatggagagctcaaatgacatcaaatggagaggacctatatgtcatggatgaaaatgaatctcccaccaatggcaacaggaagattctccacacaggcgggttcaaatttctggatagagcagcgtttatatctcccagagatctagaagaccaaaagagtggggtttacaacccctggcgtctctgccctataactcaagttgaagaagtgaagtgcatactaagacttcttccaatttggctctgcaccataatatactcagtggttttcacacaaatggcttctctttttgtggagcaaggggctgccatgaaaactacaatttccaatttcagaataccacctgcaagcatgtctagctttgacatcctcagtgtagctgtcttcattttcttctaccgtcgagtgattgatccacttgttggaagacttaaaaagaaaagttccaggggacttactgagcttcaaagaatgggaattgggcttgttatagctgtaatggctatggtttcagctggaatagttgaatgctacagacttaagtatgcaaactcaggatgcccccactgcagtggcacaagctctctaagcatcttctggcaaattcctcagtacgcacttattggagcttcagaggtttttatgtatgtaggccagttagagttcttcaatgctcagacgccagatggcttaaagagctttggaagtgccctttgcatgacgtccatctctcttgggaactacgtaagtagcatacttgttagtatagttatgaagatctccaccgaggatcacatgccagggtggatccctggaaacttaaatagaggtcacctagataggttttatttcctcttagctatcttgacatcaatagacttggtcctttatattgcatgtgcaaagtggttcaagagtatacagttggaagggaaatatgaagagaatgatatgcctggtagctttaaagtctaa

SEQ ID NO: 246 - protein, 597 aa, Glycine max
  misc_feature (1)..(597): Ceres Annot ID no. 8755095
  misc_feature (1)..(597): Bit score of 992.6 for HMM based on sequences of Figure 6
  misc_feature (1)..(597): Functional Homolog Of SEQ ID NO. 209
  misc_feature (108)..(515): Pfam Name: PTR2 Pfam Description: POT family
MACLEVSKEGKFKGDTEELTLDGSVDWHGRPAIRAKSGRWVAGTIVLLNQGLATLAFFGVGVNLVLFLTRVMGQNNAAAANSVSKWTGTVYIFSLVGAFLSDSYWGRYKTCAIFQVIFVIGLVSLSLSSYLSLIRPKGCGNETIPCGKHSSLEMGMFYLSIYLIALGNGGYQPNIATFGADQFDEEHSKEGYSKVAFFSYFYLALNLGSLFSNTILGYFEDEGLWALGFWVSAGSAFAALVLFLLGTPRYRHFKPSGNPLSRFSQVLVAASRKWRAQMTSNGEDLYVMDENESPTNGNRKILHTGGFKFLDRAAFISPRDLEDQKSGVYNPWRLCPITQVEEVKCILRLLPIWLCTIIYSVVFTQMASLFVEQGAAMKTTISNFRIPPASMSSFDILSVAVFIFFYRRVIDPLVGRLKKKSSRGLTELQRMGIGLVIAVMAMVSAGIVECYRLKYANSGCPHCSGTSSLSIFWQIPQYALIGASEVFMYVGQLEFFNAQTPDGLKSFGSALCMTSISLGNYVSSILVSIVMKISTEDHMPGWIPGNLNRGHLDRFYFLLAILTSIDLVLYIACAKWFKSIQLEGKYEENDMPGSFKV

SEQ ID NO: 247 - protein, 592 aa, Vitis vinifera
  misc_feature (1)..(592): Public GI ID no. 147827175
  misc_feature (1)..(592): Bit score of 1011.6 for HMM based on sequences of Figure 6
  misc_feature (1)..(592): Functional Homolog Of SEQ ID NO. 209
  misc_feature (109)..(516): Pfam Name: PTR2 Pfam Description: POT family
  misc_feature (577)..(577): Xaa can be any naturally occurring amino acid
MGINLEVSKEVKFKAGEEACTLDGTVDCRGNPAIRSRSGKWFAGIIILLNQGLATLAFFGVGVNLVLFLTRVLQQNNADAANNVSKWTGTVYIFSLVGAFLSDSYWGRYKTCAIFQVIFVIGLVSLSLSSYIFLVKPEGCGNEDSPCPSHSSLEIGLFYLSIYLVALGNGGYQPNIATLGADQFDEEDPKEGHSKVAFFSYFYLALNLGSLFSNTILSYLEDEGMWALGFWVSAGSAFLALILFLGGTPRYRHFKPSGNPLSRFCQVMVAAMRKFRVEMPPSAEDLYEGDGKECSNNSIRRILHTDGFKFLDRAAFISSKDSDNQEQGFYNQWRLCPITQVEEVKCILRLIPIWLCTIIYSVVFTQMASLFVEQGAAMKTTVSNFRIPPASMSSFDILSVAAFIFLYRRVLDPLVGRIRKTDTKGLTELQRMGIGLIIAIIAMIAAGIVECYRLKYAQKDCTNCEGSSSLSIFWQVPQYAFIGASEVFMYVGQLEFFNAQTPDGLKSFGSALCMTSISLGNYVSSLLVTMVMKISTEDHMPGWIPGNLNKGHLDRFYFLLATLTALDLVVYVACAKXYKCIKMEBRANEYGV

SEQ ID NO: 248 - DNA, 2631 bp, Panicum virgatum
  misc_feature (1)..(2631): Ceres Clone ID no. 1888865
  misc_feature (1)..(2631): Encodes the peptide sequence at SEQ ID NO. 249
acctcgtccgcctcgttggctccgcaccgctgcatctctctagagacaaaggcaggccgcgtgctcccctgcgtagtccttcgagcaggtacgagcggcctcctcctccgtcttcttgattccgccatggcttctgcagcagtagaggggtggagattccggcggtttctgaatcttcttgtttctgtgctttatgagttatgagtatggttggtaatggcgtccgcttgctagtggccactatgctgaaaaattgggcgagcctttagtgttcagaactcgatgaccaacttctaggagttaggtctgcctcaaattcagatccccccactttgtttgtgtggattactgaagtggccaataatttgagcaatttgtccattttttccctcgactaacttgtgccaacaaaaaatgtttttttcttgaagaaatttgatgtctgtatttgagtcgttaaatcgtgtcccatttatattgtttctattctgatgcaaatccacgcctagtcacaatctctgaaatttcaaggcttcttgtgcacacttgctccgtttattgacatctaggactatcacactgaatcttcagtaacagtatcgttgtatgctcgcaggacaggaggcctctgattctctgagcttgtacaccatctgagcgacgccatgggagaggttgcagacatgtacacccaagacgggaccgtcgacatgaaggggaaccccgccgtgaagaagggcaccggcaactggcgcgcctgcccttacatcctcgcgaatgagtgctgcgagaggctggcgtactatggcatgagcaccaacctggtgaactacatgaagacccgcctcggccaggggaactctgtcgccgccaacaatgtcaccaactggagcggaacgtgctacatcacgccactcatcggcgcattcttggctgacgcctacatggggagatactggaccatcgcgagcttcatgatcatctacatcattggcctggcgctgctgacgatggcgtcgtcggtgaaggggctggtgccgtcgtgcgacagcagcgggacgtgccacccgacggagtcgcagtcggcggcagtgttcgtggcgctgtacctgatcgcgctgggcacgggcgggatcaagccctgcgtgtcatcctttggcgccgaccagttcgacgagaacgacgagcgggagcagaagagcaagagctccttcttcaactggttctacttctccatcaacatcggcgcgctggtggcgtcgacggtgctggtgtacgtgcagacgcacgtcggctggggctggggcttcggcatccccgccgtggtgatggccatcgccgtcgtcagcttcatcatcggcacgccgctgtaccggcaccagcgccccgggggcagcccgatcacgcgcatcgcgcaggtgctcgtcgcgtccgcgcgcaagtggagcgtggccgtgcccgccgacaaggcgcagctgcacgagacgctggacaaggagtccggcatcgagggcagccgcaagctagagcacacggaccagttcagctgcctcgacaaggcggccgtcgtgacggccaaggacggggcggcggtgagcccgtggcggctgtgcacggtgacgcaggtggaggagctcaagagcgtggtgcggctgctgcccatctgggcgaccgggatcgtgttcgcgacggtgtacgggcagatgagcaccatgttcgtgctgcagggcaacacgctggaccagcgcatgggccccaggttcagcatcccctcggcgacgttgtccatggtggacaccatcagcgtcatcatctgggtgcccatctacgaccgcgccatcgtgcccttcgtgcggtccgtgacggggcgcccgcgcgggttcacgcagctgcagcgcatgggcatcggcctcgtgatctccatcttctccatggtggcggcgggcgtgctcgacgtggtgcggctgcgcgccgtggcgcggcacggcctgtacggcgacaaggacacggtgcccatctccatcttctggcagatcccgcagtacttcatcatcgggtgcgcggaggtgttcaccttcgtggggcagctggagttcttctacgaccaggcgcccgacgccatgaggagcctgtgctcggcgctgtcgctcaccaccgtggcgctgggcaactacctgagcacggtgctggtgaccatcgtgacgcgcatcaccaccacgcacggcaggctcgggtggatcccggacaacctcaaccgcggccacctcgactacttcttctggctgctcgccgtgctcagcctcctcaacttcctcgtctacctggtcatcgccaagtggtacaagtacaagaagacggcggaatacccggacgccaaaggcggggagcacaactgatgaagcggtgcagggcagggctgcaggctgactgaacggacaaggcgaaaacgaagtgatttctctgtctgtgtggttggctctttcggtttgtttgtgagagttcgccgcgtgtttaaacgtagcagttcactgtaggtgacagggtcgaatgaattgtttagtatgtcatgtgtcagtaatacgcgcaatgcttgatcccaactatcagtatctataaaataagttcagctcc

SEQ ID NO: 249 - protein, 576 aa, Panicum virgatum
  misc_feature (1)..(576): Ceres Clone ID no. 1888865
  misc_feature (1)..(576): Bit score of 918.9 for HMM based on sequences of Figure 6
  misc_feature (1)..(576): Functional Homolog Of SEQ ID NO. 209
  misc_feature (97)..(497): Pfam Name: PTR2 Pfam Description: POT family
MGEVADMYTQDGTVDMKGNPAVKKGTGNWRACPYILANECCERLAYYGMSTNLVNYMKTRLGQGNSVAANNVTNWSGTCYITPLIGAFLADAYMGRYWTIASFMIIYIIGLALLTMASSVKGLVPSCDSSGTCHPTESQSAAVFVALYLIALGTGGIKPCVSSFGADQFDENDEREQKSKSSFFNWFYFSINIGALVASTVLVYVQTHVGWGWGFGIPAVVMAIAVVSFIIGTPLYRHQRPGGSPITRIAQVLVASARKWSVAVPADKAQLHETLDKESGIEGSRKLEHTDQFSCLDKAAVVTAKDGAAVSPWRLCTVTQVEELKSVVRLLPIWATGIVFATVYGQMSTMFVLQGNTLDQRMGPRFSIPSATLSMVDTISVIIWVPIYDRAIVPFVRSVTGRPRGFTQLQRMGIGLVISIFSMVAAGVLDVVRLRAVARHGLYGDKDTVPISIFWQIPQYFIIGCAEVFTFVGQLEFFYDQAPDAMRSLCSALSLTTVALGNYLSTVLVTIVTRITTTHGRLGWIPDNLNRGHLDYFFWLLAVLSLLNFLVYLVIAKWYKYKKTAEYPDAKGGEHN

SEQ ID NO: 250 - protein, 569 aa, Vitis vinifera
  misc_feature (1)..(569): Public GI ID no. 157337163
  misc_feature (1)..(569): Bit score of 877.3 for HMM based on sequences of Figure 6
  misc_feature (1)..(569): Functional Homolog Of SEQ ID NO. 209
  misc_feature (96)..(497): Pfam Name: PTR2 Pfam Description: POT family
MAEEDNYTKDGTINYQGNPANKKKTGTWTACPYILGNEFCERLAYYGMSSNLVLYFKYKLHQDSATASKNVLNWSGTCYLTPFIGAFLADAYLGRYWTIASFSIIYVIGMTLLTVTASVPGLKPNCSPSGVCDPTETQTAVCFLALYLVALGTGGIKPCVSSYGADQFDDTDEHEKTHKSSFFNWFYLSINVGALIAGSILVWIQENIGWGVGFGIPAAAMAIAVVSFFSGTRLYRNQKPGGSPLTRMSQVVVASLKKYRVQVPADKSLLYEIADGESGIQGSRKLDHTKDLSFFDKAAVEIQSDHIKDSPDPWKICTVTQVEELKAIIRLLPVWATGIIFSAVYSQMGSLFVVQGESMDPHMGRHFEIPSASLSIFDTISVIFWVPIYDRIIVPVARKFTGHSNGITQLQRMGIGLFISIFAMLSAGILEVVRLGIVKRHNYYDHDRIPLSIFYQVPQYFIIGCAEVFTFIGQLEFFYEQAPDAMRSFCSALSLATVALGNYLSSLLVTIVTDVSTRGGKLGWIPDNLNRGHLHYFFFLLAILSVLNLVAFLFVAKWYTYKRAVGTLR

SEQ ID NO: 251 - protein, 580 aa, Oryza sativa
  misc_feature (1)..(580): Public GI ID no. 115434472
  misc_feature (1)..(580): Oryza sativa Japonica Group
  misc_feature (1)..(580): Bit score of 919.1 for HMM based on sequences of Figure 6
  misc_feature (1)..(580): Functional Homolog Of SEQ ID NO. 209
  misc_feature (98)..(499): Pfam Name: PTR2 Pfam Description: POT family
MGEVAEDIYTQDGTVDVKGNPATKKNTGNWRACPYILANECCERLAYYGMSTNLVNYMKTRLGQESAIAANNVTNWSGTCYITPLLGAFLADAYMGRFWTIASFMIIYILGLALLTMASSVKGLVPACDGGACHPTEAQTGVVFLALYLIALGTGGIKPCVSSFGADQFDENDEGEKRSKSSFFNWFYFSINIGALVASSVLVYVQTHVGWGWGFGIPAVVMAVAVASFFVGTPLYRHQRPGGSPLTRIAQVLVASARKWGVEVPADGSRLHETLDRESGIEGSRKLEHTGQFACLDRAAVETPEDRSAANASAWRLCTVTQVEELKSVVRLLPIWASGIVFATVYGQMSTMFVLQGNTLDASMGPHFSIPAASLSIFDTLSVIVWVPVYDRLIVPAVRAVTGRPRGFTQLQRMGIGLVISVFSMLAAGVLDVVRLRAIARHGLYGDKDVVPISIFWQVPQYFIIGAAEVFTFVGQLEFFYDQAPDAMRSMCSALSLTTVALGNYLSTLLVTIVTHVTTRNGAVGWIPDNLNRGHLDYFFWLLAVLSLINFGVYLVIASWYTYKKTADSPDDKAEHAGAN

SEQ ID NO: 252 - DNA, 1833 bp, Oryza sativa
  misc_feature (1)..(1833): Ceres Annot ID no. 6252512
  misc_feature (1)..(1833): Encodes the peptide sequence at SEQ ID NO. 253
atgtctggcaacgacggagacatgaagatgagggtgatcgtcgtggaaggcgatgagacgagtaacgccccgaaggatgtatgctgcgagtacaccctcgatggctccgtggatatcaagggctcaccggcggtgaagggcaagtccggcggatggctcgccggcggccttattcttctgaaccagggtctggcaaccctggcgttcttcggggtaaacgtgaacctggtgttgttcctgacgagggtgctgcagcagagcaacggcgacgccgccaacaacgtgagcaaatggaccggcacggtttacatgttctccctcatcggcgccttcctcagcgactcctactggggccgctacaagacctgcgccatattccaggccatctttgtccttggcctcgcgctgctgtccctgtcgtcgcggctgtacctgatcaggccggtcgggtgcggcacggagcacgtgccctgcgagccgcactccggcgcggagctggggatcttctacatcgcgctgtacatgatcgcgttcggcaacggcgggtaccagcccaacgtcgccaccttcggcgccgaccagttcgacggcgaggacccggccgagtcgcactccaaggtctccttcttcagctacttctacctggcgctcaacctcggctcgctcttctccaacaccttcctcagcttcctcgaggacgagggcaactgggcgctcggcttctgggtctccaccgccgccgcggccaccgcgctgctgctgttcctcggcggcacgctccgctaccggtacatccgccccagcggcaacccggttggcaggatcttccaggtcgcgttcgccgcgtgcaggaactggaaggccggcgagtcgccgggcgccgtgacactctacgagagcgacgagaaggcggattccggtgggaggaagctcctgcacacggaaggtttcaggttcttggaccgtgcggcggtggtgggcgctaacccgaagcttggcacgtgcacccaaccgcgtgacccctggaagctgtgcacggtgacgcaggtggaggaggtgaagagcatcctgcggctcctccccatctggctctgcaccatcctctattcggtcgtgttcacgcagatggcgtcgctgttcgtcgtgcagggcgccgcgatgcgccgcaccacccggttcccgggcttctccgtcccgccctccagcatgtcggccttcgacatcctcaccgtcgccaccaccatcttcctgtaccgccgggccgtctgcccgctcgtgtcgcggctcacgggccgccacaccggcccaaccgagctgcagaggatgggcctcggcctggtgctcggcgcgatggccatggccaccgccggcacggtcgagcacttcaggaaggccggcgccaccacggcgatgagcagcgacctgcacatcatgtggcaggtgccgcagtacgcgctgatcggcgtgtcggaggtgatgatgtacgtcggccagctcgagttcttcaacggggagatgcccgacgcgctcaagagcttcgggagcgcgctctgcatgatgtccatgtcgctcggcaactacttcagcgacgtcatcgtgagcgcggtgaccaaggccaccgccgtgcgcggccgccccggctggatccccgccgaccttaacgagggccacctcgacaagttcttcttcctgctcgccgtgctggccgtcgcggacttcgccgtgtacctcgtgtgcgcgagccggtacaggagtggcacggtggacgtcgaccggagcgacggggaggaggaggatggcgtggccggcaggcagatggcggcaacggtgtaa

SEQ ID NO: 253 - protein, 610 aa, Oryza sativa
  misc_feature (1)..(610): Ceres Annot ID no. 6252512
  misc_feature (1)..(610): Bit score of 940.7 for HMM based on sequences of Figure 6
  misc_feature (1)..(610): Functional Homolog Of SEQ ID NO. 209
  misc_feature (120)..(520): Pfam Name: PTR2 Pfam Description: POT family
MSGNDGDMKMRVIVVEGDETSNAPKDVCCEYTLDGSVDIKGSPAVKGKSGGWLAGGLILLNQGLATLAFFGVNVNLVLFLTRVLQQSNGDAANNVSKWTGTVYMFSLIGAFLSDSYWGRYKTCAIFQAIFVLGLALLSLSSRLYLIRPVGCGTEHVPCEPHSGAELGIFYIALYMIAFGNGGYQPNVATFGADQFDGEDPAESHSKVSFFSYFYLALNLGSLFSNTFLSFLEDEGNWALGFWVSTAAAATALLLFLGGTLRYRYIRPSGNPVGRIFQVAFAACRNWKAGESPGAVTLYESDEKADSGGRKLLHTEGFRFLDRAAVVGANPKLGTCTQPRDPWKLCTVTQVEEVKSILRLLPIWLCTILYSVVFTQMASLFVVQGAAMRRTTRFPGFSVPPSSMSAFDILTVATTIFLYRRAVCPLVSRLTGRHTGPTELQRMGLGLVLGAMAMATAGTVEHFRKAGATTAMSSDLHIMWQVPQYALIGVSEVMMYVGQLEFFNGEMPDALKSFGSALCMMSMSLGNYFSDVIVSAVTKATAVRGRPGWIPADLNEGHLDKFFFLLAVLAVADFAVYLVCASRYRSGTVDVDRSDGEEEDGVAGRQMAATV

SEQ ID NO: 254 - DNA, 1770 bp, Medicago truncatula
  misc_feature (1)..(1770): Ceres Annot ID no. 1569074
  misc_feature (1)..(1770): Encodes the peptide sequence at SEQ ID NO. 255
atggaaggaaatgagaattacagagaagaggttgttatggaagaaagtggcagagcgaatgagaataaaaaaggaggaaccaaagttgcaaccctcttgttagtgaatcaagcactggctactttagctttctttggagttggagtgaacttggttctgttcctaactagagttcttggtcaagacaatgccgaagctgctaataatgtgagcaagtggacaggaaccgtttacatgttctcattggttggagcatttctcagtgactcttattggggtcgatacttaacctgcacaatctttcaacttttctttgttctcggattggcactgtcatgtttgtcatcatggcgttttttgatcaacccaagtggatgtggtaatggccatattccttgtaagccatcatcaattggagttagcattttctacttttctatatatcttgttgcatttggttatggaggacaccaaccaaccttagcaacctttggagctgaccaatatgatgagaggaatccaaaagagaggagtttaaaagtagctttcttctgttatttttacttttccctcaacgttggatctttgttctccaatactgtattggtctattatgaggacacggggaagtggacaatgggtttctttatatcattgatctctgctatcatagcccttttgacatttttatcaggatctcctaaatatagatacttgaagccatcaggaaaccctgtcgtaagggttgctcaggtttttacagctgctgctaggaaatgggatgttgctccagccaaggcagacaaactttttgaggttctgggttctagatctgccatcaaaggttgtagaaagattctgcacagtgatgattttcgattgatggacaaagctgcaaccattacaaagaatgatgatgagcagattggaaacaatccatggaagctttgcacagtgactcaagttgaggaaacaaaatgcgtgttaagaatgcttccaatttggctatgcaccatttgttactctgttgtatttacacaaatggcatcactatttgttgagcaaggggatgtgatgaactctaacatcggagaatttcatttgccagcagccagcatgtctgtgtttgacatctgtagtgtgctagtatgcactgtaatatatcgcacaatccttgttccgttagtaggaagattgattggtaatacaaggggaattagtgaacttgaaagaatgggaattgggttaataattgcaatgttgtcaatggttgcatcaggtatgacagagatggtaaggctgagaaatataattcctgggcagaaaagaagttcaatgagtatattctatcaaattccacagtatgttctgattggtgcttcagaggttttcatgtatgtgggtcaattggagttctttaatggtcaagcaccagatggaataaaaagttttgggagttcactttgtatggcttcaatttctcttggaaactatgtgagtagcatgcttgttcacgtggtcatgaaaatcactgcaagagggaatgacaaaggttggattccagagaacctaaacaaagggcacatggataggtttttctttcttctagcagggctagttgtttttgattttgtgatttacttgttctgtgctaagtggtacaagagtatcaatgttcaaggtgaccaagaggagttggatgatgatgatgctcaagttattataattaagtcggcatccaaagaccaacctttaacaccacaagaataa

SEQ ID NO: 255 - protein, 589 aa, Medicago truncatula
  misc_feature (1)..(589): Ceres Annot ID no. 1569074
  misc_feature (1)..(589): Bit score of 896.5 for HMM based on sequences of Figure 6
  misc_feature (1)..(589): Functional Homolog Of SEQ ID NO. 209
  misc_feature (96)..(492): Pfam Name: PTR2 Pfam Description: POT family
MEGNENYREEVVMEESGRANENKKGGTKVATLLLVNQALATLAFFGVGVNLVLFLTRVLGQDNAEAANNVSKWTGTVYMFSLVGAFLSDSYWGRYLTCTIFQLFFVLGLALSCLSSWRFLINPSGCGNGHIPCKPSSIGVSIFYFSIYLVAFGYGGHQPTLATFGADQYDERNPKERSLKVAFFCYFYFSLNVGSLFSNTVLVYYEDTGKWTMGFFISLISAIIALLTFLSGSPKYRYLKPSGNPVVRVAQVFTAAARKWDVAPAKADKLFEVLGSRSAIKGCRKILHSDDFRLMDKAATITKNDDEQIGNNPWKLCTVTQVEETKCVLRMLPIWLCTICYSVVFTQMASLFVEQGDVMNSNIGEFHLPAASMSVFDICSVLVCTVIYRTILVPLVGRLIGNTRGISELERMGIGLIIAMLSMVASGMTEMVRLRNIIPGQKRSSMSIFYQIPQYVLIGASEVFMYVGQLEFFNGQAPDGIKSFGSSLCMASISLGNYVSSMLVHVVMKITARGNDKGWIPENLNKGHMDRFFFLLAGLVVFDFVIYLFCAKWYKSINVQGDQEELDDDDAQVIIIKSASKDQPLTPQE

SEQ ID NO: 256 - DNA, 1647 bp, Populus trichocarpa
  misc_feature (1)..(1647): Ceres Annot ID no. 1475845
  misc_feature (1)..(1647): Encodes the peptide sequence at SEQ ID NO. 257
atggcagaagatggctctaccaaagatggagcagcagatttccgaaatgaatgctgcgaaaggttggcctactatggaatcaacacaaatctagttaattacctcaaatttcaactaaaccagagcaatgttgtggcggtcaataacgtcaccaattggtcaggaacatgctatgtcatgccattgcttggagcttttcttgctgatgcctacttgggaagatattggacaattgctagtttctctataatctatgtctttggaatgacattgttgacattgtcagcatcgatccatggactaaaaccatcttgcgacagaacgaatgtttgccatacaacagggttgcagacatcagttttctttctaggcctataccttatagccctggggactggagggatcaagccttgtgtctcttcctttggtgcggatcaattcgatgactctgacgaggatgagaagaaaaggaagagttccttcttcaattggttctatttttcaatcaatatcggcgctcttattgctgcttctgtgcttgtttggatacaaaccaatgtaggctggggctggggctttggcatcccagcagtggcaatggcaattgctgttgtgagtttcttttcaggtacacggttatacaggaaccagagacttggagggagtcccttaacacgaatgtgccaagtgctagttgcatccttcaggaaattccgtgtcgaagtgcctaatgacaagtctcttctgtttgagacagcagaccatgaatctgctgtcatgggaagccgcaaacttgaccacacagatcagttaagtttctttgacaaggcagcagtggagactccatcagaccgtctaaaagggtccgcgaatcagtggaaactgtgcaccgtgactcaggttgaagagctcaagtccatcattcggttgcttcctgtatgggcaactggcataatattttctgctgtatacagtcaaatgggaaccttatttgtcctgcagggaaacacaatggaccttcgcatgggcaaatccttcgaaatcccttctgcttcactctccctctttgacacaattagtgtaatcttctgggtaccgatttacgaccgtgccatcgtgccctttgcaagaagatttactggacacaagaatggattcacacagcttcaaagaattgcaattggccttgtaatttccatctttgccatgttggttgctgggactctagagcttgtgaggctccgcgaggtcagaaaacataactactatgaactaaagcacataccaatgtccatattttggcaggtccctcagtatttcattataggatgtgcagaagttttcacatttatcgggcaattagagttcttttatgagcaggcacccgatgccatgaggagcctttgctcagctctctcactcacaaccgctgcacttgggaactacttgagcacattcctagttaatattgtcacggatatgagcaccaggcatggtaagcctggttggataccggacaatttgaatcatggccatcttcattattttttctggctcttggcagtgttgagtgtgctcaacttgggggtctatcttttggttgccagatggtacacttacaagaaagctgtggtgtccagtgattga

SEQ ID NO: 257 - protein, 548 aa, Populus trichocarpa
  misc_feature (1)..(548): Ceres Annot ID no. 1475845
  misc_feature (1)..(548): Bit score of 839.9 for HMM based on sequences of Figure 6
  misc_feature (1)..(548): Functional Homolog Of SEQ ID NO. 209
  misc_feature (75)..(476): Pfam Name: PTR2 Pfam Description: POT family
MAEDGSTKDGAADFRNECCERLAYYGINTNLVNYLKFQLNQSNVVAVNNVTNWSGTCYVMPLLGAFLADAYLGRYWTIASFSIIYVFGMTLLTLSASIHGLKPSCDRTNVCHTTGLQTSVFFLGLYLIALGTGGIKPCVSSFGADQFDDSDEDEKKRKSSFFNWFYFSINIGALIAASVLVWIQTNVGWGWGFGIPAVAMAIAVVSFFSGTRLYRNQRLGGSPLTRMCQVLVASFRKFRVEVPNDKSLLFETADHESAVMGSRKLDHTDQLSFFDKAAVETPSDRLKGSANQWKLCTVTQVEELKSIIRLLPVWATGIIFSAVYSQMGTLFVLQGNTMDLRMGKSFEIPSASLSLFDTISVIFWVPIYDRAIVPFARRFTGHKNGFTQLQRIAIGLVISIFAMLVAGTLELVRLREVRKHNYYELKHIPMSIFWQVPQYFIIGCAEVFTFIGQLEFFYEQAPDAMRSLCSALSLTTAALGNYLSTFLVNIVTDMSTRHGKPGWIPDNLNHGHLHYFFWLLAVLSVLNLGVYLLVARWYTYKKAVVSSD

SEQ ID NO: 258 - DNA, 1929 bp, Populus trichocarpa
  misc_feature (1)..(1929): Ceres Annot ID no. 1501483
  misc_feature (1)..(1929): Encodes the peptide sequence at SEQ ID NO. 259
atggaaggcatgaccaaggttgtggcaaacactcttctaaggagacctctcttccctgttccattttccacccatattttcttctttaatggcaacaacaaaagaaaatattctattgctgctatggattcagacccttccaccgattatgtgacaggagaaagtgtcatctctagagaaaatgtagctgtgaacagaatcagaactgaggaagaacacgatattgctagcaataagcgctccattacttggaagagctctggagggtggaaagctgcaagcatcttgctagcaaatcaatgcctggctacactagctttctttggagttggtgtgaatttggttctgttcttaacaagagttcttggtcaaagtaatgctgatgctgccaatagtgtcagcaagtggactggcacagtttatctgtgctcactcataggagctttcctcagtgattcatactggggcagatacttgacctgtgcagtctttcagttaatattcgtttcggggttggcgctcgtatcggtatcatcttgttatttcttgatcaaaccagatggatgtggtgatggagaattagcctgtgagccaacatcgtcggtgggagtggctattttttacttggctatatatttagttgcctttggatatggtgggcatcaaccttctttagccacatttggagcagaccaatttgacgagtcgaaaccgaaagaaaaaaattacaaggcagcttacttttgctatttctattttgcactcaactttggatctctattctcaaacactattttggtgtattttgaggatcatggaaaatggacactaggtttcctggtgtcattaggctctgcagttttagccttggtatcgttcttgtttgggacacctggttaccagtatgtgaaaccttgcggcaaccctttgccgcgagttgctcaggtgtttgtggctgcagttaagaaatgggatgttatcccggcgaaagctgatgaactttatgaagtggaaggaccagaatctgctatcaaagggagcagaaagattcttcatagtgatgattttgagtttttggacaaggcagcaacagtaacagaggatgatctaagtcaccaaaagaatccatggaggctttgcacaataagtcaagtagaggaagctaaatgtgttcttaaaatgttacctatttggctatgcactataatttactctgttgttttcacacaaatggcctccctctttgttgagcaaggagatgtcatgaactcctatgctggaaagtttcacctaccagcagctagcatgtctgcctttgatatctgcagtgtccttgtttgcactgggatttatcgccaaatcctcgtgccattagctggaaggttaagtggtaataccaaggggttaacggagcttcagagaatgggaatcggactcatcattgggatgctagcaatgttcgcagcaggggctactgagattgaaaggctcaagcatgttactgaagggaaaaaagttagctcactaagcatattttggcaaattccacaatacgttcttgtcggtgcatctgaggttttcatgtatgtaggccagttggagttctttaacgggcaagcaccagacgggattaagagttttggaagctcactttgcatggcttcaatctcccttggcaactatgtcagcagcatgctagtcagcatggtgatgaagattacagctaaaggtgacaagcctggatggatcccagatgacttgaacacaggccacatggacaggttctacttcctgattgcagtcttaacagcctttgattttgtgatttacttgttctgtgccaactggtacacgcctatcaacattgatgacagccacggaggaattgggatggaaaagcaagaagatgatgcgcttgcaagagtttaa

SEQ ID NO: 259 - protein, 601 aa, Populus trichocarpa
  misc_feature (1)..(601): Ceres Annot ID no. 1501483
  misc_feature (1)..(601): Bit score of 921.6 for HMM based on sequences of Figure 6
  misc_feature (1)..(601): Functional Homolog Of SEQ ID NO. 209
  misc_feature (119)..(514): Pfam Name: PTR2 Pfam Description: POT family
MDSDPSTDYVTGESVISRENVAVNRIRTEEEHDIASNKRSITWKSSGGWKAASILLANQCLATLAFFGVGVNLVLFLTRVLGQSNADAANSVSKWTGTVYLCSLIGAFLSDSYWGRYLTCAVFQLIFVSGLALVSVSSCYFLIKPDGCGDGELACEPTSSVGVAIFYLAIYLVAFGYGGHQPSLATFGADQFDESKPKEKNYKAAYFCYFYFALNFGSLFSNTILVYFEDHGKWTLGFLVSLGSAVLALVSFLFGTPGYQYVKPCGNPLPRVAQVFVAAVKKWDVIPAKADELYEVEGPESAIKGSRKILHSDDFEFLDKAATVTEDDLSHQKNPWRLCTISQVEEAKCVLKMLPIWLCTIIYSVVFTQMASLFVEQGDVMNSYAGKFHLPAASMSAFDICSVLVCTGIYRQILVPLAGRLSGNTKGLTELQRMGIGLIIGMLAMFAAGATEIERLKHVTEGKKVSSLSIFWQIPQYVLVGASEVFMYVGQLEFFNGQAPDGIKSFGSSLCMASISLGNYVSSMLVSMVMKITAKGDKPGWIPDDLNTGHMDRFYFLIAVLTAFDFVIYLFCANWYTPINIDDSHGGIGMEKQEDDALARV

SEQ ID NO: 260 - DNA, 1821 bp, Populus trichocarpa
  misc_feature (1)..(1821): Ceres Annot ID no. 8755079
  misc_feature (1)..(1821): Encodes the peptide sequence at SEQ ID NO. 261
atggattcgttctcttccaccaacgctgtgctaaagaagcaggtgacaggagaaagtagtatcatctctagggaaaatgtagctgtgaagagaatcagaactgaggaagaacaggagattgctaacagaaagccttcccttatttggaagagaactggagggtggacagctgcaagcatcttgctagcaaatcaatgcctggctacactagctttctttggagttggtgtgaatttggttctattcttaacaagagttcttggtcaaagtaatgctgatgctgccaataatgtcagcaagtggactggcacagtttatctgtgctcactcgtaggagctttcctcagtgattcatactggggtagatacttgacctgtgcaatctttcagctaatattcgtctcgggattggtgctcgtatcggtatcatcttggtttttcttgatcaaaccagatggatgtggtgatggaaaattaacctgtgtgccggcaacatcgatgggacaagttgttttctacttggctatatacttagtagcctttggatatggtggacatcaaccttccatagcgacatttggagcagatcaatttgacgagtcgaaaccgaaagaaagaaattccaaggcagctttcttttgctatttctattttgcactcaactttggatctttattctcaaacacccttttggtgtactttgaggatcatggcagatggacactaggcttcctgctatcattaggttctgcagtcgtagccttggtatcattcttgtttggggcacctggttacaagtacgtaaaaccttgcggcaaccctttgccgcgagttgctcaggtgtttgtggctgcagctaggaaatgggatgttatcccggtgaaagctgatgaactgtatgaactagaaggaccagaatctgctatcaaagggagcaggaagatttttcacagtgaagaatttgagtttttggacaaggcagcaacaatgacagaggatgatttgagtcaccaaaagaatccatggaggctttgcacaataactcaagtagaggaagccaaatgtgttcttaaaatgttacctatttggttatgcactattatttactctgttgtcttcactcagatggcatccctctttgttgagcaaggagatgtcatgaattcctatattggaaagtttcacctcccagctgctagcatgtctgccttcgatatctgcagtgtccttgtttgcactggaatttatcgtcaaatcctcgtgccattagctggaaggttaagtggtaatcctaaggggttaactgagcttcagaggatgggaattggactcgtcattggaatgctagcaatgcttgcagcgggtgctactgagattgaaaggctcaagaatgttattgaagggcacaaagtcagctctttaagcatattttggcaaattccacaatatgttcttgttggtgcatctgaggttttcatgtatataggtcaattggagttctttaacgggcaagcaccagacgggattaagagttttggaagctcactttgcatggcttcaatctctcttggcaactatgccagtagcatgctagttaatatggtgatgaagattacaactaaaggtgacaagcctggatggatcccagatgacttgaacacaggacacatggacaggttttacttcctgattgcagtgttaacagcctttgatttcgtgatttacttgttctgtgccaagtggtacaagcctatcaacattgatgacagtcagggaattgagatggaaaagcaagaagatgatgtgcttgcaaaagtttaa

SEQ ID NO: 261 - protein, 606 aa, Populus trichocarpa
  misc_feature (1)..(606): Ceres Annot ID no. 8755079
  misc_feature (1)..(606): Bit score of 928.2 for HMM based on sequences of Figure 6
  misc_feature (1)..(606): Functional Homolog Of SEQ ID NO. 209
  misc_feature (125)..(520): Pfam Name: PTR2 Pfam Description: POT family
MDSFSSTNAVLKKQVTGESSIISRENVAVKRIRTEEEQEIANRKPSLIWKRTGGWTAASILLANQCLATLAFFGVGVNLVLFLTRVLGQSNADAANNVSKWTGTVYLCSLVGAFLSDSYWGRYLTCAIFQLIFVSGLVLVSVSSWFFLIKPDGCGDGKLTCVPATSMGQVVFYLAIYLVAFGYGGHQPSIATFGADQFDESKPKERNSKAAFFCYFYFALNFGSLFSNTLLVYFEDHGRWTLGFLLSLGSAVVALVSFLFGAPGYKYVKPCGNPLPRVAQVFVAAARKWDVIPVKADELYELEGPESAIKGSRKIFHSEEFEFLDKAATMTEDDLSHQKNPWRLCTITQVEEAKCVLKMLPIWLCTIIYSVVFTQMASLFVEQGDVMNSYIGKFHLPAASMSAFDICSVLVCTGIYRQILVPLAGRLSGNPKGLTELQRMGIGLVIGMLAMLAAGATEIERLKNVIEGHKVSSLSIFWQIPQYVLVGASEVFMYIGQLEFFNGQAPDGIKSFGSSLCMASISLGNYASSMLVNMVMKITTKGDKPGWIPDDLNTGHMDRFYFLIAVLTAFDFVIYLFCAKWYKPINIDDSQGIEMEKQEDDVLAKV

SEQ ID NO: 262 - protein, 572 aa, Oryza sativa
  misc_feature (1)..(572): Public GI ID no. 115470147
  misc_feature (1)..(572): Oryza sativa Japonica Group
  misc_feature (1)..(572): Bit score of 840.0 for HMM based on sequences of Figure 6
  misc_feature (1)..(572): Functional Homolog Of SEQ ID NO. 209
  misc_feature (93)..(496): Pfam Name: PTR2 Pfam Description: POT family
MEATTTDGTTDHAGKPAVRSKSGTWRACPFILGNECCERLAYYGMSANLVNYMVDRLRQGNAGAAASVNNWSGTCYVMPLVGAFLADAYLGRYRTIAAFMALYIVGLALLTMSASVPGMKPPNCATISASSCGPSPGQSAAFFVALYLIALGTGGIKPCVSSFGADQFDDADPREHRSKASFFNWFYMSINVGALVASSVLVWVQMNVGWGWGFGIPAVAMAVAVASFLMGSSLYRHQKPGGSPLTRMLQVVVAAARKSRVALPADAAALLYEGDKLACGTRRLAHTEQFRWLDRAAVVTPTTDKDDDTGSRWRLCPVTQVEELKAVVRLLPVWASGIVMSAVYGQMSTMFVLQGNTLDPRMGATFKIPSASLSIFDTLAVLAWVPVYDRLIVPAARRFTGHPRGFTQLQRMGIGLLISVFSMVAAGVLEVVRLRVAAAHGMLDSTSYLPISIFWQVQYFIIGAAEVFAFIGQIDFFYDQAPDDMRSTCTALSLTSSALGNYLSTLLVVIVTAASTRGGGLGWIPDNLNRGHLDYFFWLLAALSAVNFLVYLWIANWYRCKTITTTEAAAQT

SEQ ID NO: 263 - protein, 570 aa, Arabidopsis thaliana
  misc_feature (1)..(570): Public GI ID no. 15240905
  misc_feature (1)..(570): Bit score of 855.3 for HMM based on sequences of Figure 6
  misc_feature (1)..(570): Functional Homolog Of SEQ ID NO. 209
  misc_feature (97)..(498): Pfam Name: PTR2 Pfam Description: POT family
MEDDKDIYTKDGTLDIHKKPANKNKTGTWKACRFILGTECCERLAYYGMSTNLINYLEKQMNMENVSASKSVSNWSGTCYATPLIGAFIADAYLGRYWTIASFVVIYIAGMTLLTISASVPGLTPTCSGETCHATAGQTAITFIALYLIALGTGGIKPCVSSFGADQFDDTDEKEKESKSSFFNWFYFVINVGAMIASSVLVWIQMNVGWGWGLGVPTVAMAIAVVFFFAGSNFYRLQKPGGSPLTRMLQVIVASCRKSKVKIPEDESLLYENQDAESSIIGSRKLEHTKILTFFDKAAVETESDNKGAAKSSSWKLCTVTQVEELKALIRLLPIWATGIVFASVYSQMGTVFVLQGNTLDQHMGPNFKIPSASLSLFDTLSVLFWAPVYDKLIVPFARKYTGHERGFTQLQRIGIGLVISIFSMVSAGILEVARLNYVQTHNLYNEETIPMTIFWQVPQYFLVGCAEVFTFIGQLEFFYDQAPDAMRSLCSALSLTAIAFGNYLSTFLVTLVTKVTRSGGRPGWIAKNLNNGHLDYFFWLLAGLSFLNFLVYLWIAKWYTYKKTTGHAL

SEQ ID NO: 264 - DNA, 1809 bp, Populus trichocarpa
  misc_feature (1)..(1809): Ceres Annot ID no. 8755085
  misc_feature (1)..(1809): Encodes the peptide sequence at SEQ ID NO. 265
atggattcagacccttccaccgattatcaggtgacaggagaaagtgtcatctctagagaaaatgtagctgtgaacagaatcagaactgaggaagaacacgatattgctagcaataagcgctccattacttggaagagctctggagggtggaaagctgcaagcatcttgctagcaaatcaatgcctggctacactagctttctttggagttggtgtgaatttggttctgttcttaacaagagttcttggtcaaagtaatgctgatgctgccaatagtgtcagcaagtggactggcacagtttatctgtgctcactcataggagctttcctcagtgattcatactggggcagatacttgacctgtgcagtctttcagttaatattcgtttcggggttggcgctcgtatcggtatcatcttgttatttcttgatcaaaccagatggatgtggtgatggagaattagcctgtgagccaacatcgtcggtgggagtggctattttttacttggctatatatttagttgcctttggatatggtgggcatcaaccttctttagccacatttggagcagaccaatttgacgagtcgaaaccgaaagaaaaaaattacaaggcagcttacttttgctatttctattttgcactcaactttggatctctattctcaaacactattttggtgtattttgaggatcatggaaaatggacactaggtttcctggtgtcattaggctctgcagttttagccttggtatcgttcttgtttgggacacctggttaccagtatgtgaaaccttgcggcaaccctttgccgcgagttgctcaggtgtttgtggctgcagttaagaaatgggatgttatcccggcgaaagctgatgaactttatgaagtggaaggaccagaatctgctatcaaagggagcagaaagattcttcatagtgatgattttgagtttttggacaaggcagcaacagtaacagaggatgatctaagtcaccaaaagaatccatggaggctttgcacaataagtcaagtagaggaagctaaatgtgttcttaaaatgttacctatttggctatgcactataatttactctgttgttttcacacaaatggcctccctctttgttgagcaaggagatgtcatgaactcctatgctggaaagtttcacctaccagcagctagcatgtctgcctttgatatctgcagtgtccttgtttgcactgggatttatcgccaaatcctcgtgccattagctggaaggttaagtggtaataccaaggggttaacggagcttcagagaatgggaatcggactcatcattgggatgctagcaatgttcgcagcaggggctactgagattgaaaggctcaagcatgttactgaagggaaaaaagttagctcactaagcatattttggcaaattccacaatacgttcttgtcggtgcatctgaggttttcatgtatgtaggccagttggagttctttaacgggcaagcaccagacgggattaagagttttggaagctcactttgcatggcttcaatctcccttggcaactatgtcagcagcatgctagtcagcatggtgatgaagattacagctaaaggtgacaagcctggatggatcccagatgacttgaacacaggccacatggacaggttctacttcctgattgcagtcttaacagcctttgattttgtgatttacttgttctgtgccaactggtacacgcctatcaacattgatgacagccacggaggaattgggatggaaaagcaagaagatgatgcgcttgcaagagtttaa

SEQ ID NO: 265 - protein, 602 aa, Populus trichocarpa
  misc_feature (1)..(602): Ceres Annot ID no. 8755085
  misc_feature (1)..(602): Bit score of 921.6 for HMM based on sequences of Figure 6
  misc_feature (1)..(602): Functional Homolog Of SEQ ID NO. 209
  misc_feature (120)..(515): Pfam Name: PTR2 Pfam Description: POT family
MDSDPSTDYQVTGESVISRENVAVNRIRTEEEHDIASNKRSITWKSSGGWKAASILLANQCLATLAFFGVGVNLVLFLTRVLGQSNADAANSVSKWTGTVYLCSLIGAFLSDSYWGRYLTCAVFQLIFVSGLALVSVSSCYFLIKPDGCGDGELACEPTSSVGVAIFYLAIYLVAFGYGGHQPSLATFGADQFDESKPKEKNYKAAYFCYFYFALNFGSLFSNTILVYFEDHGKWTLGFLVSLGSAVLALVSFLFGTPGYQYVKPCGNPLPRVAQVFVAAVKKWDVIPAKADELYEVEGPESAIKGSRKILHSDDFEFLDKAATVTEDDLSHQKNPWRLCTISQVEEAKCVLKMLPIWLCTIIYSVVFTQMASLFVEQGDVMNSYAGKFHLPAASMSAFDICSVLVCTGIYRQILVPLAGRLSGNTKGLTELQRMGIGLIIGMLAMFAAGATEIERLKHVTEGKKVSSLSIFWQIPQYVLVGASEVFMYVGQLEFFNGQAPDGIKSFGSSLCMASISLGNYVSSMLVSMVMKITAKGDKPGWIPDDLNTGHMDRFYFLIAVLTAFDFVIYLFCANWYTPINIDDSHGGIGMEKQEDDALARV

SEQ ID NO: 266 - protein, 551 aa, Vitis vinifera
  misc_feature (1)..(551): Public GI ID no. 147853446
  misc_feature (1)..(551): Bit score of 908.3 for HMM based on sequences of Figure 6
  misc_feature (1)..(551): Functional Homolog Of SEQ ID NO. 209
  misc_feature (115)..(517): Pfam Name: PTR2 Pfam Description: POT family
MGSQEEEEVRSLLETGLLQNENSDLHTGDGSVDIHGKPVLRSNTGNWRACPFILGTECCERLAYYGIATNLVTYLTSKLHEGNVSAARNVTTWQGTCYLTPLIGAVLADAYCGRYWTIAAFSTIYFIGMCTLTLSATVPAFKPADCVGSVCPPATTAQYAVFFFGLYLIALGTGGIKPCVSSFGADQFDDTDPKERVKKGSFFNWFYFSINIGALVSSSFLVWIQDNAGWGLGFGIPALFMGIAIASFFSGTPLYRFQKPGGSPITRMCQVLVASFRKWKLEVPKDSNLLYETPDKNSAIEGSRKLEHSNELKCLDKAAVISDAEIKSGDFSNPWNLCTVTQVEELKILIRMFPIWATGIVFSAVYAQMSTMFVEQGMVMDTTVGSFTIPPASLSTFDVISVIFWVPVYDRILVPIARKFTGKERGFSELQRMGIGLFLSVLCMSAAALVEIKRLQLATALDLVDEDVAVPLSILWQIPQYFLLGAAEVFTFIGQLEFFYDQSPDAMRSLCSASSLLTTSLGNYLSAFILTVVTTLTTEBGKTGWIPDNLE

SEQ ID NO: 267 - protein, 547 aa, Vitis vinifera
  misc_feature (1)..(547): Public GI ID no. 157346087
  misc_feature (1)..(547): Bit score of 754.9 for HMM based on sequences of Figure 6
  misc_feature (1)..(547): Functional Homolog Of SEQ ID NO. 209
  misc_feature (96)..(487): Pfam Name: PTR2 Pfam Description: POT family
MAEDDMYTKDGTMNIHNKPANKKKTGQWKACRFILGNECCERLAYYGMSTNLVNYLQIRLNQGNVTASNNVTNWSGTCYITPLIGAFLADAYFGRFWIIAIFSIIYFCGMVLLTMTASIKGLRPSCDDNGCDPTKLQSAVCFIALYLIALGTGGIKPCVSSFGADQFDVNDEAEKKKKSSFFNWFYLSINVGALIASSVLVWIQMNVGWGWGFGIPAVAMAIAVVSFFSGSRMYRLQKPGGSPLTRICQVLVASTRKYHVKVPNNKSLLYETKDAESNIKGSCKLEHTEKLRFFDKAAVEVESDHVKSSNNPWKLCTVTQVEELKSILRLLPVWATGILFSTVYSQMSTMFVLQGNTMDQHMGPNFKIPSASLSLFDTLSVIFWAPVYDRIIVPFARKFTGHERGFTQLQRMGIGLVISIISMIVAGILEVIRLNYVRKHNYYDLEYIPMSIFWQVPQYFLIGCAEVFTFIGQLEFYYDQAPDATRITIVNKVTTRNGKMGWIPDNMNRGHLDYFYWLLAILSLLNFLVYLWIAKWYTYKKVTGRPG

SEQ ID NO: 268 - DNA, 1797 bp, Populus trichocarpa
  misc_feature (1)..(1797): Ceres Annot ID no. 1538867
  misc_feature (1)..(1797): Encodes the peptide sequence at SEQ ID NO. 269
atggcttgtttggaggtttgtaaggagggtaagttcaaagagggacgagaagaatgcacttttgatggaacagttgattggcatggtcgtcctgctatcaaagacaaatctgggcaatgggttgctggaattattatacttttgaaccaaggtctagcaacacttgcattctttggtgttggtgtgaacttagttctgttcctgacaagggttttgcaacaaagcaatgccgatgctgctaataacgttagcaaatggaccgggaccgtctacatcttctctcttgttggtgctttcctcagcgattcctactggggaagatacaaaacctgtgcaatttttcaggtcatctttgtcataggcctagtaatcctatcactctcgtcataccttttcttaatcagaccaaaaggatgtgggaatgagctgactccatgtggatcccattcaagcatggaagtttcattgttttacctctccatttacctcgttgctctaggaaatggagggtatcaacctaacattgctacatttggggctgatcagtttgatgaagaggaccccagggaaggacattccaaggttgcattttttagctacttctacctggccttgaacctcggttccctcttttccaacacaatattggggtattttgaggatgaaggggtgtgggcactaggattctgggcgtctgcaggttctgcctttgcagcattggtcttgtttctaggaggaacatctagataccggcacttcaaaccaagtggtaaccctctctccaggttctgccaagtcatcatcgctgcaatgaagaaatggaagctcgagatgccacgagatggagaggaggagctgtataatgtccatgcaaaagattgctcgatgaatggcaacagaaagattctccacactgatggattcaagttcttggatagagcagctttcatctcttcaagagatattgatgatcaaaagcggggctgtcgcaacccatggcgtctgtgcccaattacacaagtagaagaagttaaatgcatactgagactactcccaatttggctctgcaccataatctattcagtggttttcacacagatggcctctctgtttgttgagcagggtgctgcaatgaaaactacagtatcaaacttcaaaatccctcctgccagcatgtctagcttcgatattctaagtgttgcgtttttcattttcctatatcggcgagttcttgatccacttgtaagcagagttaaaaagacgggttcaaaaggactaactgaacttcaaagaatgggtgttggccttgtgatagcaatagtggcaatgatttcggctgggcttgtggagtgttatagactcaggtatgcaagaaaagactgcacacactgtgaaggctcaagctctatgagcatcttctggcaagttcctcagtatgcacttattggagcttctgaagttttcatgtatgttggtcaactggagttctttaatgcacaaactcctgatggattaaagagcttcggaagtgcactttgtatgacatctatctcgctagggaattacgtgagtagcttgcttgtgactatggttatgaagatctcgactgaggatcacatgcccggatggatccccggaaatctgaacaaaggtcacctggataggttttacttcctcttagcaaccttgacaactatagacctagttgtgtatatagcatgtgctaggtggtacaagtctatccaactggaaggaaaatgcgagctgaatgatcaggaagagaacttcagagtctga

SEQ ID NO: 269 - protein, 598 aa, Populus trichocarpa
  misc_feature (1)..(598): Ceres Annot ID no. 1538867
  misc_feature (1)..(598): Bit score of 1012.3 for HMM based on sequences of Figure 6
  misc_feature (1)..(598): Functional Homolog Of SEQ ID NO. 209
  misc_feature (108)..(516): Pfam Name: PTR2 Pfam Description: POT family
MACLEVCKEGKFKEGREECTFDGTVDWHGRPAIKDKSGQWVAGIIILLNQGLATLAFFGVGVNLVLFLTRVLQQSNADAANNVSKWTGTVYIFSLVGAFLSDSYWGRYKTCAIFQVIFVIGLVILSLSSYLFLIRPKGCGNELTPCGSHSSMEVSLFYLSIYLVALGNGGYQPNIATFGADQFDEEDPREGHSKVAFFSYFYLALNLGSLFSNTILGYFEDEGVWALGFWASAGSAFAALVLFLGGTSRYRHFKPSGNPLSRFCQVIIAAMKKWKLEMPRDGEEELYNVHAKDCSMNGNRKILHTDGFKFLDRAAFISSRDIDDQKRGCRNPWRLCPITQVEEVKCILRLLPIWLCTIIYSVVFTQMASLFVEQGAAMKTTVSNFKIPPASMSSFDILSVAFFIFLYRRVLDPLVSRVKKTGSKGLTELQRMGVGLVIAIVAMISAGLVECYRLRYARKDCTHCEGSSSMSIFWQVPQYALIGASEVFMYVGQLEFFNAQTPDGLKSFGSALCMTSISLGNYVSSLLVTMVMKISTEDHMPGWIPGNLNKGHLDRFYFLLATLTTIDLVVYIACARWYKSIQLEGKCELNDQEENFRV

SEQ ID NO: 270 - DNA, 1779 bp, Medicago truncatula
  misc_feature (1)..(1779): Ceres Annot ID no. 8755091
  misc_feature (1)..(1779): Encodes the peptide sequence at SEQ ID NO. 271
atggcttgcttagaggtctgcaaagaggggaagttcaaagaagaaacagaagagttaactcttgatgggagtgttgattggcatggtcgcccatcaatcagagccacatccgggagatggtttgccggaactattatactcttgaaccaaggtctagcaaccttagcattctttggagttggagtgaacctagttctgttcttgacaagggtgttgggtcaagataatgctgctgctgctaacaatgtcagcaagtggactggcacagtttacatcttctctcttgttggtgctttccttagtgattcttattggggaagatacaaaacatgtgctatctttcaaggcatttttgtaaccggtctagtatctttgtccgttacaacataccttgctttgcttagaccaaaaggttgtggaaatggaaaacttgaatgtggggaacattcaagtttggaaatgggaatgttctacctatcaatctatctgattgccttaggaaatggagggtatcaaccaaacattgcaacatttggtgctgaccaatttgatgaagatcactcaaaggagagttattcaaaagtggcattttttagctacttttacttggcattgaaccttggttcacttttctcaaacactattttgggctattttgaagatgaaggattatgggctcttgggttttgggcttctgctgggtctgcctttttggctcttgtactttttcttgttggcaccccaaaatatagacactttaaaccttgtggcaatcctctttctagattctgccaagtgtttttcgctgcttcaaggaaattgggagttcaaatgacttcaaatggagatgacttgtatgtcatagatgaaaaggagtcttctaacaactccaacagaaagattctccacacacatggcttcaagtttttggatagggcagcttatataacttcaagagatttagaggtccaaaaaggaggccaacataacccatggtatctgtgtcctattactcaagttgaagaagtaaaatgcatactaagacttcttccaatttggctttgcacaataatctactcagtagttttcactcagatggcttccctttttgtggagcaaggtgctgcaatgaaaaccacaatttccagtttcaaaataccaccagcaagcatgtctagcttcgatatcctcagcgtagccatcttcattttcttctaccgtcgagtacttgatccactcgtcggaaaactcaaaaaatcaagttccaagggactcactgaacttcaaagaatgggaatcggtctcgttatagctataatcgcaatggttacagctggaatagttgaatgttacaggcttaagtatgcaaaacaaggtgacacaagctctctaagtatcttctggcaaattcctcagtatgcacttataggagcttctgaggtttttatgtatgtaggacaattagaatttttcaatgctcaaacacctgatggattaaagagctttggaagtgcactttgcatgacaagtatctcacttgggaactatgtgagtagcttaattgttagtattgttatgaagatttcaactgaagatcacatgccaggatggatccctggaaacttgaatagaggtcacttggataggtttttcttcctattggctgttttgacttctttagatttgattgcttatattgcatgtgcaaagtggtttcagaatattcagatggcatgcaaatatgataacaatgacgagcctagtagctgcaaagtttaa

SEQ ID NO: 271 - protein, 592 aa, Medicago truncatula
  misc_feature (1)..(592): Ceres Annot ID no. 8755091
  misc_feature (1)..(592): Bit score of 970.5 for HMM based on sequences of Figure 6
  misc_feature (1)..(592): Functional Homolog Of SEQ ID NO. 209
  misc_feature (108)..(510): Pfam Name: PTR2 Pfam Description: POT family
MACLEVCKEGKFKEETEELTLDGSVDWHGRPSIRATSGRWFAGTIILLNQGLATLAFFGVGVNLVLFLTRVLGQDNAAAANNVSKWTGTVYIFSLVGAFLSDSYWGRYKTCAIFQGIFVTGLVSLSVTTYLALLRPKGCGNGKLECGEHSSLEMGMFYLSIYLIALGNGGYQPNIATFGADQFDEDHSKESYSKVAFFSYFYLALNLGSLFSNTILGYFEDEGLWALGFWASAGSAFLALVLFLVGTPKYRHFKPCGNPLSRFCQVFFAASRKLGVQMTSNGDDLYVIDEKESSNNSNRKILHTHGFKFLDRAAYITSRDLEVQKGGQHNPWYLCPITQVEEVKCILRLLPIWLCTIIYSVVFTQMASLFVEQGAAMKTTISSFKIPPASMSSFDILSVAIFIFFYRRVLDPLVGKLKKSSSKGLTELQRMGIGLVIAIIAMVTAGIVECYRLKYAKQGDTSSLSIFWQIPQYALIGASEVFMYVGQLEFFNAQTPDGLKSFGSALCMTSISLGNYVSSLIVSIVMKISTEDHMPGWIPGNLNRGHLDRFFFLLAVLTSLDLIAYIACAKWFQNIQMACKYDNNDEPSSCKV

SEQ ID NO: 272 - DNA, 1713 bp, Populus trichocarpa
  misc_feature (1)..(1713): Ceres Annot ID no. 1492702
  misc_feature (1)..(1713): Encodes the peptide sequence at SEQ ID NO. 273
atggcagaggaggatgtttatacaaaagatggaacagtggattatcgtgggaatccagctaacaaaaaggagacgggaacctggagagcctgcccttatattataggaaatgaattttgtgaacgattggcttactatgggatgagctccaatctgattctttatttcaagcacagactgaatcaacaaagcgctacagctactagaaataacttgaattggggtggaacgtgctatctcactccattgattggagcattctttgctgatgcttatcttggtagatattggacgattgcttgtttctccatcatatatgttatggggatgacacttttgacaatctcagctactgtccctggcctaaggccaaaatgttatgcagaagatgattgtaatccaacagatgctcaaagtgcattagcttttgtatcactttacctaatagcactaggcactggtggtattaagccttgtgtctcatcctatggagcagatcagtttgatgacgctgatgaggttgagaaaaaacacaagagttctttcttcaactggttctacctctcaattaatgttggtgctcttattgccggttctgtgctggtttgggtacaagataatgtgagttggggttggggttttggcattccagcaatagccatggcaattgcggttgcgagcttcttttcaggtactcggttgttcaggtatcaaaagcctggaggcagccctcttactcgcatctgtcaggtgctgttggcatccttcagaaaaaagaaagttgaagttccagctgacaaggctttgttgtatgagactgcggatgccgaatccaacatcaaaggaagccgcaagcttgaccatactgaagaatttagtttccttgacaaggcagcagtggaaacagaaaaggacgacataaaggggccagtagacccatggagactttgcactgtaacccaagttgaggagctaaagtctatcattcggttgcttcccatatgggccacaggtatcatctttactgcagtgtacagccagatggggaacctatttgtgctgcaaggtgaacagatggataaatatgttggaaactccaatttccagataccatctgcatctctatcaatctttgacactcttagtgtcattttttgggtcccggtctatgaccgaattattgtcccagttgcaagaaaatacaccggacacaaaaatggcttaactcaactgcagcggatgggcattggtctcttcatatcaatattttccatggtatctgcagcaatcttggaacttaaaagacttgaaatggtgagaaggcacaactcctacgaacttaaaaccgtgcccttgtctatattttggcaagctccacagtatttcctgatagggtgtgcagaagttttcacattcatcggacagttggaattcttctacgagcaagcacctgatgcaatgaggagcatgtgttctgccctatcactcaccaccgtcgcacttggtagttacttaagctctcttcttgtaaccattgttacaagcatcagcactaagaatggaaagcctggatggataccggagaacttaaattatggtcacattgattacttcttctggctactgggagtactcagtgtgctgaatctatgtgtctttctcttgatctcaaattggtacacgtataaaaagccagtgggaactcttcgttga

SEQ ID NO: 273 - protein, 570 aa, Populus trichocarpa
  misc_feature (1)..(570): Ceres Annot ID no. 1492702
  misc_feature (1)..(570): Bit score of 878.4 for HMM based on sequences of Figure 6
  misc_feature (1)..(570): Functional Homolog Of SEQ ID NO. 209
  misc_feature (96)..(498): Pfam Name: PTR2 Pfam Description: POT family
MAEEDVYTKDGTVDYRGNPANKKETGTWRACPYIIGNEFCERLAYYGMSSNLILYFKHRLNQQSATATRNNLNWGGTCYLTPLIGAFFADAYLGRYWTIACFSIIYVMGMTLLTISATVPGLRPKCYAEDDCNPTDAQSALAFVSLYLIALGTGGIKPCVSSYGADQFDDADEVEKKHKSSFFNWFYLSINVGALIAGSVLVWVQDNVSWGWGFGIPAIAMAIAVASFFSGTRLFRYQKPGGSPLTRICQVLLASFRKKKVEVPADKALLYETADAESNIKGSRKLDHTEEFSFLDKAAVETEKDDIKGPVDPWRLCTVTQVEELKSIIRLLPIWATGIIFTAVYSQMGNLFVLQGEQMDKYVGNSNFQIPSASLSIFDTLSVIFWVPVYDRIIVPVARKYTGHKNGLTQLQRMGIGLFISIFSMVSAAILELKRLEMVRRHNSYELKTVPLSIFWQAPQYFLIGCAEVFTFIGQLEFFYEQAPDAMRSMCSALSLTTVALGSYLSSLLVTIVTSISTKNGKPGWIPENLNYGHIDYFFWLLGVLSVLNLCVFLLISNWYTYKKPVGTLR

SEQ ID NO: 274 - DNA, 1887 bp, Zea mays
  misc_feature (1)..(1887): Ceres Clone ID no. 325604
  misc_feature (1)..(1887): Encodes the peptide sequence at SEQ ID NO. 275
ggggttgggggaggccctctgtctccatggatgaggcagcagggctgctgttgcaagaagagggtggaggtggggaccaagaagctctcctccttccacttccacaggatgttggcctttacacaggtgatggatctgttgatgtcaaagggcgccctgcgttaaagggcactacaggcaattggaaagcatgctttttcatcctagggaatgaatgttgtgaaaggctggcctactacggaattgcaaaaaacctagttacttatttgaaagtgaagcttcatctaggcaacctcgaggctgcaagacatgttaccacttggcaagggacatgctatctcactccccttgttggaggcatcttagcagactctcgttgggggaaatactggactattgctgttttctcatcggtttactttattggcctggctattttaacgctttctgcatcagtcccagcgttgcaaccaccttcatgtttaaggacagtttgtccagaagcaagcttacttcagtatggcatattttttggtggcctctatatgattgccctagggactggaggtatcaaaccttgtgtctcctcctttggagctgatcaatttgatgacactgaccaagcagagagagctaagaagggttcattcttcaattggttctacttctgtataaatatagtttcattcatatcaggcactatgatagtgtggatacaagataacactggttggggaataggctttgcgattcctactatattcatggcattagctatttcattcttcttctcagcttcaaataagtacagattccaaaaacctggtgggagtccactcacaagagtgtgccaggtggttatagcagcatttcgtaagtggcacattgaagtgccacatgatacatctctcctatatgaagttgatggccaaacttcagcaattgaaggaagccggaagctggagcacacaaatgagctcgagttccttgatagagctgctgttatctcatctgctgatctgaagagtgaatcctttaccgacccatggaagctttgcacagttacccaggtggaagaattgaagatcctaataagaatgtttcccatttgggctactactatcatattcagtgctgtttatgcccaaaactcttccatgttcatagagcagggcatggttcttgacaagcgcattgggtctttcaacattcctcctgcatctctctccacttttgatgtaatcagcgtcatcatgtgggtcccactctatgaccgcatcctggtgccactagctagaaaattcactggaagggagaagggtttttctgagctacagcggatgggaattggattagtcctgtccattctcgcgatgttatctgcagctctagttgagttgaagcgtttagagattgccaggtctgaaggtctcattcatgagaaggctgctgttccaatgagcattctttggcaaataccacaatatttcttggtgggcgctgctgaggtgtttacttgtattggtcaagttgagttcttttacgatcaggccccagatgccatgaggagtttatgtagtgcacttgcacttattacagtctcactgggaaactatataagctccatcatactgacattggtgtcgtacattacaactcagggaggagatcctggatggatccctgacaatctgaatgaaggccatctcgaccggttcttttggttaattgcagggataagctttgtaaatttgatagtttatatgggttgtgctgtcagatacagatataagaaagcctcttgattatatttatgtgaactcttgtaatgtgatttcccattcccgatatcatacttatcaaatacaatgcactgtacagatttct

SEQ ID NO: 275 - protein, 592 aa, Zea mays
  misc_feature (1)..(592): Ceres Clone ID no. 325604
  misc_feature (1)..(592): Bit score of 907.0 for HMM based on sequences of Figure 6
  misc_feature (1)..(592): Functional Homolog Of SEQ ID NO. 209
  misc_feature (121)..(523): Pfam Name: PTR2 Pfam Description: POT family
MDEAAGLLLQEEGGGGDQEALLLPLPQDVGLYTGDGSVDVKGRPALKGTTGNWKACFFILGNECCERLAYYGIAKNLVTYLKVKLHLGNLEAARHVTTWQGTCYLTPLVGGILADSRWGKYWTIAVFSSVYFIGLAILTLSASVPALQPPSCLRTVCPEASLLQYGIFFGGLYMIALGTGGIKPCVSSFGADQFDDTDQAERAKKGSFFNWFYFCINIVSFISGTMIVWIQDNTGWGIGFAIPTIFMALAISFFFSASNKYRFQKPGGSPLTRVCQVVIAAFRKWHIEVPHDTSLLYEVDGQTSAIEGSRKLEHTNELEFLDRAAVISSADLKSESFTDPWKLCTVTQVEELKILIRMFPIWATTIIFSAVYAQNSSMFIEQGMVLDKRIGSFNIPPASLSTFDVISVIMWVPLYDRILVPLARKFTGREKGFSELQRMGIGLVLSILAMLSAALVELKRLEIARSEGLIHEKAAVPMSILWQIPQYFLVGAAEVFTCIGQVEFFYDQAPDAMRSLCSALALITVSLGNYISSIILTLVSYITTQGGDPGWIPDNLNEGHLDRFFWLIAGISFVNLIVYMGCAVRYRYKKAS

SEQ ID NO: 276 - protein, 621 aa, Oryza sativa
  misc_feature (1)..(621): Public GI ID no. 108707040
  misc_feature (1)..(621): Oryza sativa Japonica Group
  misc_feature (1)..(621): Bit score of 839.6 for HMM based on sequences of Figure 6
  misc_feature (1)..(621): Functional Homolog Of SEQ ID NO. 209
  misc_feature (150)..(550): Pfam Name: PTR2 Pfam Description: POT family
MEGVLLQQELPKKQFKAEHLSSWRVQQPFRAAKGAFMGSSLEAEQQSLIVRTTEPEDVDDYTGDGSVGFSGQPILKHETGNWRACSLILGTEVCERLAYYGISKSLVTYLSTRLHEGNVSAARNFTTWQGTCYLTPLIGATLADSYWGKYKTIAVFSTIYFLGMAALTFSALVPSLQPPQCFGSFCPQPTVPQYLIYFVGLYMIALGSGGIKPCVSSFGADQFDDTDPVERTKKGAFFNWFYFAINIGSLISGTVLIWVQQNCGYGIGFGIPTIFIALAIGSFFIGSQRYRYQIPGGSPLIRVCQVVIAAIHKRNVDLPVDSSVLYELHGKTSAIEGSRKLEHSSEFSFLDKAAVILSNERGGSHDPWRLCTITQVEELKILMRMFPIWATGIVFFTVCAQNSSMFIEQGMALNNQIESFKIPPATLSSLDVISIVVWVPIYETFVVPIASRLTGKERGFSELQRMGIGLFVATTAVATAALVEIKRLEIARSEDLIHSKVPVPMSILWQAPQYLLVGIGEVFTAIGQAEFFYNQSPDSMRSLCSAFALVTVSLGSYLSSFILTLVSYFTTRDDNPGWIPDNLNEGHLDRFFWLIAGLSFLNLLLFVYYAQQYKCKKAAAI

SEQ ID NO: 277 - DNA, 1845 bp, Arabidopsis thaliana
  misc_feature (1)..(1845): Ceres Annot ID no. 1302517
  misc_feature (1)..(1845): Encodes the peptide sequence at SEQ ID NO. 278
atgtcttgcctagagatttataacaaagacacgatgaagaagaaagaaggagaagaagaaacaagagatgggacagtggattactatggtcgtccctctattcgttctaactcaggccaatgggttgctggcatcgtcattcttctgaaccaggggctggctacactagccttctttggagttggagtgaacttggtgctcttcctaactcgcgttttgcagcagaacaacgcagacgcagctaacaacgttagcaaatggacagggactgtttatatcttctcattggttggagcgtttctcagcgattcgtattggggtcgttacaagacttgtgctatcttccaagtcatttttgtcattggactttcatcgctatcgctatcatcatacatgttcttgattagaccaagaggttgtggggacgaagtcacgccttgtggttcacattccatgatggagatcacaatgttctacttctcgatctacttgatcgcattgggatatggcggttaccaaccaaacattgcaacgcttggagcggatcagttcgatgaggagcatcctaaagaagggtactcgaagattgcgtttttcagctacttttaccttgctttaaacctcggatcgctcttttcgaacaccatcttggggtattttgaggatgagggaatgtgggcactcgggttttgggcatccactggctctgctatcattgggttgattcttttccttgttggaacaccgagataccgatatttcaagcccacggggaatcctctttcgaggttttgccaagttttggtcgctgcaacgaagaaatcatcggtggaggcaccattaagagggagagaggagatgtatgacggagacagcgaagggaaaaatgcttcagttaacacagggagaaggatagtgcataccgatgaattcaagttcttggacaaagcagcgtacatcacagctagagatctagatgacaagaaacaagactcagtgaacccatggaggctctgtccagtgacacaagtcgaggaagtcaagtgtattcttagactgatgccaatttggctctgcactataatctactcagtcgtcttcactcaaatggcctctctctttgtggagcaaggcgctgcaatgaatacctctgtctcagatttcaaaatccccccggcaagtatgtccagcttcgacatccttagcgtcgctttgttcatattcctgtaccgcagagttctcgagccagtagccaacagattcaaaaagaatggatcaaaaggaatcaccgagcttcacaggatgggaatcggacttgtgattgctgtcatagctatgattgcagccgggattgtggaatgctataggcttaagtatgcagacaagagttgtactcactgtgatggctcaagctccttaagcatcttctggcaggctccacaatactcactcatcggggcatcagaagtgttcatgtacgtgggtcagcttgagttcttcaacgcgcaaacaccagacggactaaagagcttcgggagcgctctgtgtatgatgtcaatgtcaatggggaactttgttagtagcttgttggtaacaatggtggtgaagatctcaacagaggatcacatgcctggttggattccaaggaatctcaacaaaggtcacttagacagattctatttcctcctggctgcgttgacgagcattgacctggtggtatacattgcatgtgcaaaatggtacaaacctatacaactagaaggaaaagatgagatgcaagacatgagtgatgatgactatgacaccgagagtgaagaggaacgagagaaggattctaaagtctaa

SEQ ID NO: 278 - protein, 614 aa, Arabidopsis thaliana
  misc_feature (1)..(614): Ceres Annot ID no. 1302517
  misc_feature (1)..(614): Bit score of 970.5 for HMM based on sequences of Figure 6
  misc_feature (1)..(614): Functional Homolog Of SEQ ID NO. 209
  misc_feature (109)..(518): Pfam Name: PTR2 Pfam Description: POT family
MSCLEIYNKDTMKKKEGEEETRDGTVDYYGRPSIRSNSGQWVAGIVILLNQGLATLAFFGVGVNLVLFLTRVLQQNNADAANNVSKWTGTVYIFSLVGAFLSDSYWGRYKTCAIFQVIFVIGLSSLSLSSYMFLIRPRGCGDEVTPCGSHSMMEITMFYFSIYLIALGYGGYQPNIATLGADQFDEEHPKEGYSKIAFFSYFYLALNLGSLFSNTILGYFEDEGMWALGFWASTGSAIIGLILFLVGTPRYRYFKPTGNPLSRFCQVLVAATKKSSVEAPLRGREEMYDGDSEGKNASVNTGRRIVHTDEFKFLDKAAYITARDLDDKKQDSVNPWRLCPVTQVEEVKCILRLMPIWLCTIIYSVVFTQMASLFVEQGAAMNTSVSDFKIPPASMSSFDILSVALFIFLYRRVLEPVANRFKKNGSKGITELHRMGIGLVIAVIAMIAAGIVECYRLKYADKSCTHCDGSSSLSIFWQAPQYSLIGASEVFMYVGQLEFFNAQTPDGLKSFGSALCMMSMSMGNFVSSLLVTMVVKISTEDHMPGWIPRNLNKGHLDRFYFLLAALTSIDLVVYIACAKWYKPIQLEGKDEMQDMSDDDYDTESEEEREKDSKV

SEQ ID NO: 279 - DNA, 1830 bp, Arabidopsis thaliana
  misc_feature (1)..(1830): Ceres Annot ID no. 1355964
  misc_feature (1)..(1830): Encodes the peptide sequence at SEQ ID NO. 280
atggccgctatggatccgagaaataatggcaacgttgctccgctaaatgagcgggagagagcagaaaatttggaagttcgtgaagtggtagaggttcaagatgatcaaagtgtggtgtctcttatgtccaacgattctgaccttcagaaaaagatgatgaagaaagaggagaagaagaatggtggctggacaaacgcaatcattttgctagtaaatcaagggttagctacattggccttctttggtgtgggagtaaacttggtgttgttcctaacacgtgttatgggacaaggtaatgcagaagctgcgaacaatgtaagcaagtggacaggaacagtttacatgttctctctcgttggggcatttcttagtgactcctattggggtcgttacttgacttgcacgatattccaagtcatcttcgttatcggtgttggcctcctctcttttgtctcttggtttttcttgattaaacctcgaggatgtggcgatggggaccttgaatgcaaccctccctcttccctcggagttgctatcttttatctatctgtatatttggtagcttttggatacggaggccaccagccaacgctggctactttcggtgcagaccagcttgatgatgataaaaactccaaagctgcgtttttcagctacttctactttgctctcaacgtgggagctctcttttcaaacacaatccttgtttattttgaggataaagggttgtggactgaaggtttcttggtgtcactaggctccgctattgtcgcattggtggcttttttggccccaacaagacaatatcgttatgtcaagccgtgtggtaacccgttgcctcgtgtggcgcaagtatttgtggccactgctcgtaagtggagtgttgttcgaccaggagatccgcatgagttgtacgaacttgaaggtcctgaatccgccattaaaggaagtcgaaagatatttcatagtaccaaatttctcttcttggatagagcagcagtgattacagagaatgataggaatgggacaaggagcaatgcatggaggttgtgcagtgtaactcaagtagaggaggcaaaatgtgtgatgaagttgcttccaatatggctatgcactataatctactcagtgatcttcacacaaatggcgtcattgtttgtggagcaaggtgatgtgatgaatgcatacgtagggaaattccacatccccgcagcgagcatgtcggtcttcgacatattcagcgtctttgtatcaacaggaatctaccgccacatcatatttccatacgtgagacccacggaacttatgcggatggggatagggctgatcatagggataatggcaatggtagctgcaggattaacagagatccaacggctgaaacgagtagtcccggggcaaaaggagagtgagctcaccattttatggcaaattccacagtacgtgcttgtgggagcaagtgaggtgttcatgtacgttggacagttagagttcttcaacggacaagcaccagacgggttaaagaacttaggaagctcgttgtgtatggcttcgatggctttaggtaactacgtgagcagtttgatggttaatattgttatggccataaccaaaagaggtgagaatagccccgggtggataccggaaaatctcaacgaaggtcatatggatcggttttattttctgattgccgcgttagcagctatcgattttgtggtttatttgatatttgcaaagtggtaccaacccataagtcatgatgaagatagtatcaagggcggttctggtggtagtctgaagaagaccgtttctgagttggaacaagtttga

SEQ ID NO: 280 - protein, 609 aa, Arabidopsis thaliana
  misc_feature (1)..(609): Ceres Annot ID no. 1355964
  misc_feature (1)..(609): Bit score of 854.8 for HMM based on sequences of Figure 6
  misc_feature (1)..(609): Functional Homolog Of SEQ ID NO. 209
  misc_feature (132)..(517): Pfam Name: PTR2 Pfam Description: POT family
MAAMDPRNNGNVAPLNERERAENLEVREVVEVQDDQSVVSLMSNDSDLQKKMMKKEEKKNGGWTNAIILLVNQGLATLAFFGVGVNLVLFLTRVMGQGNAEAANNVSKWTGTVYMFSLVGAFLSDSYWGRYLTCTIFQVIFVIGVGLLSFVSWFFLIKPRGCGDGDLECNPPSSLGVAIFYLSVYLVAFGYGGHQPTLATFGADQLDDDKNSKAAFFSYFYFALNVGALFSNTILVYFEDKGLWTEGFLVSLGSAIVALVAFLAPTRQYRYVKPCGNPLPRVAQVFVATARKWSVVRPGDPHELYELEGPESAIKGSRKIFHSTKFLFLDRAAVITENDRNGTRSNAWRLCSVTQVEEAKCVMKLLPIWLCTIIYSVIFTQMASLFVEQGDVMNAYVGKFHIPAASMSVFDIFSVFVSTGIYRHIIFPYVRPTELMRMGIGLIIGIMAMVAAGLTEIQRLKRVVPGQKESELTILWQIPQYVLVGASEVFMYVGQLEFFNGQAPDGLKNLGSSLCMASMALGNYVSSLMVNIVMAITKRGENSPGWIPENLNEGHMDRFYFLIAALAAIDFVVYLIFAKWYQPISHDEDSIKGGSGGSLKKTVSELEQV

SEQ ID NO: 281 - DNA, 1758 bp, Arabidopsis thaliana
  misc_feature (1)..(1758): Ceres Annot ID no. 8755104
  misc_feature (1)..(1758): Encodes the peptide sequence at SEQ ID NO. 282
atggccgctatggatccgagaaataatggcaaccgggagagagcagaaaatttggaagttcgtgaagtggtagaggttcaagatgatcaaagtgtggagaagaagaatggtggctggacaaacgcaatcattttgctagtaaatcaagggttagctacattggccttctttggtgtgggagtaaacttggtgttgttcctaacacgtgttatgggacaaggtaatgcagaagctgcgaacaatgtaagcaagtggacaggaacagtttacatgttctctctcgttggggcatttcttagtgactcctattggggtcgttacttgacttgcacgatattccaagtcatcttcgttatcggtgttggcctcctctcttttgtctcttggtttttcttgattaaacctcgaggatgtggcgatggggaccttgaatgcaaccctccctcttccctcggagttgctatcttttatctatctgtatatttggtagcttttggatacggaggccaccagccaacgctggctactttcggtgcagaccagcttgatgatgataaaaactccaaagctgcgtttttcagctacttctactttgctctcaacgtgggagctctcttttcaaacacaatccttgtttattttgaggataaagggttgtggactgaaggtttcttggtgtcactaggctccgctattgtcgcattggtggcttttttggccccaacaagacaatatcgttatgtcaagccgtgtggtaacccgttgcctcgtgtggcgcaagtatttgtggccactgctcgtaagtggagtgttgttcgaccaggagatccgcatgagttgtacgaacttgaaggtcctgaatccgccattaaaggaagtcgaaagatatttcatagtaccaaatttctcttcttggatagagcagcagtgattacagagaatgataggaatgggacaaggagcaatgcatggaggttgtgcagtgtaactcaagtagaggaggcaaaatgtgtgatgaagttgcttccaatatggctatgcactataatctactcagtgatcttcacacaaatggcgtcattgtttgtggagcaaggtgatgtgatgaatgcatacgtagggaaattccacatccccgcagcgagcatgtcggtcttcgacatattcagcgtctttgtatcaacaggaatctaccgccacatcatatttccatacgtgagacccacggaacttatgcggatggggatagggctgatcatagggataatggcaatggtagctgcaggattaacagagatccaacggctgaaacgagtagtcccggggcaaaaggagagtgagctcaccattttatggcaaattccacagtacgtgcttgtgggagcaagtgaggtgttcatgtacgttggacagttagagttcttcaacggacaagcaccagacgggttaaagaacttaggaagctcgttgtgtatggcttcgatggctttaggtaactacgtgagcagtttgatggttaatattgttatggccataaccaaaagaggtgagaatagccccgggtggataccggaaaatctcaacgaaggtcatatggatcggttttattttctgattgccgcgttagcagctatcgattttgtggtttatttgatatttgcaaagtggtaccaacccataagtcatgatgaagatagtatcaagggcggttctggtggtagtctgaagaagaccgtttctgagttggaacaagtttga

SEQ ID NO: 282 - protein, 585 aa, Arabidopsis thaliana
  misc_feature (1)..(585): Ceres Annot ID no. 8755104
  misc_feature (1)..(585): Bit score of 859.0 for HMM based on sequences of Figure 6
  misc_feature (1)..(585): Functional Homolog Of SEQ ID NO. 209
  misc_feature (108)..(493): Pfam Name: PTR2 Pfam Description: POT family
MAAMDPRNNGNRERAENLEVREVVEVQDDQSVEKKNGGWTNAIILLVNQGLATLAFFGVGVNLVLFLTRVMGQGNAEAANNVSKWTGTVYMFSLVGAFLSDSYWGRYLTCTIFQVIFVIGVGLLSFVSWFFLIKPRGCGDGDLECNPPSSLGVAIFYLSVYLVAFGYGGHQPTLATFGADQLDDDKNSKAAFFSYFYFALNVGALFSNTILVYFEDKGLWTEGFLVSLGSAIVALVAFLAPTRQYRYVKPCGNPLPRVAQVFVATARKWSVVRPGDPHELYELEGPESAIKGSRKIFHSTKFLFLDRAAVITENDRNGTRSNAWRLCSVTQVEEAKCVMKLLPIWLCTIIYSVIFTQMASLFVEQGDVMNAYVGKFHIPAASMSVFDIFSVFVSTGIYRHIIFPYVRPTELMRMGIGLIIGIMAMVAAGLTEIQRLKRVVPGQKESELTILWQIPQYVLVGASEVFMYVGQLEFFNGQAPDGLKNLGSSLCMASMALGNYVSSLMVNIVMAITKRGENSPGWIPENLNEGHMDRFYFLIAALAAIDFVVYLIFAKWYQPISHDEDSIKGGSGGSLKKTVSELEQV

SEQ ID NO: 283 - protein, 568 aa, Vitis vinifera
  misc_feature (1)..(568): Public GI ID no. 147802380
  misc_feature (1)..(568): Bit score of 894.2 for HMM based on sequences of Figure 6
  misc_feature (1)..(568): Functional Homolog Of SEQ ID NO. 209
  misc_feature (96)..(496): Pfam Name: PTR2 Pfam Description: POT family
MAEDDMYTKDGTMNIHNKPANKKKTGQWKACRFILGNECCERLAYYGMSTNLVNYLQIRLNQGNVTASNNVTNWSGTCYITPLIGAFLADAYFGRFWIIAIFSIIYFCGMVLLTMTASIKGLRPSCDDNGCDPTKLQSAVCFIALYLIALGTGGIKPCVSSFGADQFDVNDEAEKKKKSSFFNWFYLSINVGALIASSVLVWIQMNVGWGWGFGIPAVAMAIAVVSFFSGSRMYRLQKPGGSPLTRICQVLVASTRKYHVKVPNNKSLLYETKDAESNIKGSCKLEHTEKLRFFDKAAVEVESDHVKSSNNPWKLCTVTQVEELKSILRLLPVWATGILFSTVYSQMSTMFVLQGNTMDQHMGPNFKIPSASLSLFDTLSVIFWAPVYDRIIVPFARKFTGHERGFTQLQRMGIGLVISIISMIVAGILEVIRLNYVRKHNYYDLEYIPMSIFWQVPQYFLIGCAEVFTFIGQLEFYYDQAPDATRSLCSALSLTTNALGNYLSTLLVTIVNKVTTRNGKMGWIPDNMNRGHLDYFYWLLAILSLLNFLVYLWIAKWYTYKKVTGRPG

SEQ ID NO: 284 - protein, 586 aa, Arabidopsis thaliana
  misc_feature (1)..(586): Public GI ID no. 510238
  misc_feature (1)..(586): Bit score of 907.7 for HMM based on sequences of Figure 6
  misc_feature (1)..(586): Functional Homolog Of SEQ ID NO. 209
  misc_feature (113)..(517): Pfam Name: PTR2 Pfam Description: POT family
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWEDLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 285 - protein, 603 aa, Vitis vinifera
  misc_feature (1)..(603): Public GI ID no. 157341962
  misc_feature (1)..(603): Bit score of 1013.4 for HMM based on sequences of Figure 6
  misc_feature (1)..(603): Functional Homolog Of SEQ ID NO. 209
  misc_feature (120)..(527): Pfam Name: PTR2 Pfam Description: POT family
MKKKAEYINFWLEFAYYLSFQVKFKAGEEACTLDGTVDCRGNPAIRSRSGKWFAGIIILLNQGLATLAFFGVGVNLVLFLTRVLQQNNADAANNVSKWTGTVYIFSLVGAFLSDSYWGRYKTCAIFQVIFVIGLVSLSLSSYIFLVKPEGCGNEDSPCPSHSSLEIGLFYLSIYLVALGNGGYQPNIATLGADQFDEEDPKEGHSKVAFFSYFYLALNLGSLFSNTILSYLEDEGMWALGFWVSAGSAFLALILFLGGTPRYRHFKPSGNPLSRFCQVMVAAMRKFRVEMPPSAEDLYEGDGKECSNNSIRRILHTDGFKFLDRAAFISSKDSDNQEQGFYNQWRLCPITQVEEVKCILRLIPIWLCTIIYSVVFTQMASLFVEQGAAMKTTVSNFRIPPASMSSFDILSVAAFIFLYRRVLDPLVGRIRKTDTKGLTELQRMGIGLIIAIIAMIAAGIVECYRLKYAQKDCTNCEGSSSLSIFWQVPQYAFIGASEVFMYVGQLEFFNAQTPDGLKSFGSALCMTSISLGNYVSSLLVTMVMKISTEDHMPGWIPGNLNKGHLDRFYFLLATLTALDLVVYVACAKWYKCIKMEDRANEYGV

SEQ ID NO: 286 - protein, 559 aa, Prunus dulcis
  misc_feature (1)..(559): Public GI ID no. 6635838
  misc_feature (1)..(559): Bit score of 891.5 for HMM based on sequences of Figure 6
  misc_feature (1)..(559): Functional Homolog Of SEQ ID NO. 209
  misc_feature (46)..(46): Xaa can be any naturally occurring amino acid
  misc_feature (113)..(515): Pfam Name: PTR2 Pfam Description: POT family
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 287 - protein, 576 aa, Arabidopsis thaliana
  misc_feature (1)..(576): Public GI ID no. 4455276
  misc_feature (1)..(576): Bit score of 958.0 for HMM based on sequences of Figure 6
  misc_feature (1)..(576): Functional Homolog Of SEQ ID NO. 209
  misc_feature (88)..(495): Pfam Name: PTR2 Pfam Description: POT family
MDQKVRQFEVCTQDGSVDRHGNPAIRANTGKWLTAILILGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 288 - DNA, 1779 bp, Sorghum bicolor
  misc_feature (1)..(1779): Ceres Annot ID no. 8642246
  misc_feature (1)..(1779): Encodes the peptide sequence at SEQ ID NO. 289
atggatgaggcaccagggctgctgttgcaagaagagggtggaggtagggaccacgaaccgctcctccttccacttccacaggatgctggcctttacacaggtgatggatctgttgatgtcaaagggtgtcctgcattaaagggcactacaggcaattggaaagcatgttttttcatcctagggaatgagtgttgtgaaaggctggcctactacggaattgcaaaaaacctagttacttatttgaaagtgaagcttcatctaggcaaccttgaggctgcaagacatgttaccacttggcaagggacatgctatcttactccccttgttggagccatcttagcagattctcattgggggaaatactggacaattgctgttttctcatcagtttactttattggcctggctattttgacgctgtcagcatcagtcccagcattgcagccaccttcatgtttaagaacagtttgtccagaagcaagcttacttcagtatggcgtattttttgttggtctctatatgatagccctagggacaggaggtatcaaaccttgtgtctcctcctttggagctgatcaatttgatgacactgacccagcagagagagctaagaagggctccttcttcaattggttctacttctgtataaatattggtgcattcatatcaggcactatcatagtgtggatacaagataacactggttggggaataggatttgcaattcctactatattcatggcattagctatttcattcttcctcacagcttcaaataagtacagattccaaaaacctggtgggagtccactcacaagagtgtgccaggtagttatagcagcatttcgtaagtggcacattgaagtgccacatgatacatctctcctctatgaagttgatggccaaacttcagcaattgagggaagccggaagctggagcacacaaatgagctcgagttccttgatagagctgccgttatctcatctgctgacctgaagagcgaatcctttacagacccatggaagctttgcacagttacccaggtggaagaattgaagattctaataagaatgtttcccgtttgggctactactatcatattcagtgctgtttacgcccaaaactcttccatgttcatagagcagggcatggttcttgacaagcgcattggatctttcaatattcctcctgcatctctctcaacttttgatgtaatcagcgtcatcatatgggttccactttatgaccgcattctggtgccagtagctagaaaattcactggaagggagaagggtttttctgagctccagcggatgggaattggattagccctgtcaattcttgcgatggtatctgcagctcttgttgagttgaagcgtttagagattgccaggtctgaaggtcttattcatgagaaggctgctgttccaatgagcattctttggcaaataccacaatatttcttggtgggtgctgctgaggtgtttacttgtataggtcaagtcgagttcttttacgatgaggccccagatgccatgaggagtttatgtagtgcatttgcacttattacagtctcactgggaagctatataagctccatcatactgacgttggtgtcgtgcattacaactcagggaggagatcctggatggatccctgacaatctgaatgaaggccatctcgaccggttcttttggttaattgctgggataagctttgtgaatttgatagtttacatgggctgtgctgtgagatacagatataagaaagcctcttga

SEQ ID NO: 289 - protein, 592 aa, Sorghum bicolor
  misc_feature (1)..(592): Ceres Annot ID no. 8642246
  misc_feature (1)..(592): Bit score of 907.0 for HMM based on sequences of Figure 6
  misc_feature (1)..(592): Functional Homolog Of SEQ ID NO. 209
  misc_feature (121)..(522): Pfam Name: PTR2 Pfam Description: POT family
MDEAPGLLLQEEGGGRDHEPLLLPLPQDAGLYTGDGSVDVKGCPALKGTTGNWKACFFILGNECCERLAYYGIAKNLVTYLKVKLHLGNLEAARHVTTWQGTCYLTPLVGAILADSHWGKYWTIAVFSSVYFIGLAILTLSASVPALQPPSCLRTVCPEASLLQYGVFFVGLYMIALGTGGIKPCVSSFGADQFDDTDPAERAKKGSFFNWFYFCINIGAFISGTIIVWIQDNTGWGIGFAIPTIFMALAISFFLTASNKYRFQKPGGSPLTRVCQVVIAAFRKWHIEVPHDTSLLYEVDGQTSAIEGSRKLEHTNELEFLDRAAVISSADLKSESFTDPWKLCTVTQVEELKILIRMFPVWATTIIFSAVYAQNSSMFIEQGMVLDKRIGSFNIPPASLSTFDVISVIIWVPLYDRILVPVARKFTGREKGFSELQRMGIGLALSILAMVSAALVELKRLEIARSEGLIHEKAAVPMSILWQIPQYFLVGAAEVFTCIGQVEFFYDEAPDAMRSLCSAFALITVSLGSYISSIILTLVSCITTQGGDPGWIPDNLNEGHLDRFFWLIAGISFVNLIVYMGCAVRYRYKKAS

SEQ ID NO: 290 - DNA, 1764 bp, Sorghum bicolor
  misc_feature (1)..(1764): Ceres Annot ID no. 8633032
  misc_feature (1)..(1764): Encodes the peptide sequence at SEQ ID NO. 291
atggccggcgccgagcgcgcggaggcggtcgctctggaggaagggctcctcgctccggaggaatccaaccaagtagtatacactggagatggatcagtcgacttttcgggaaatcctgttgtcaaggaaacaacgggtagatggaaggcatgtccattcatattaggtaatgaatgctgtgaacgactggcctattatggcatctccacgaaccttgtcacttacttgacaaaaaagctacatgctggcaatgcctctgctgctagcaatgtgactacatggcagggaacttgctacttgactccgcttattggggcaatcctggctgatgcatactgggggaggtattggacgattgcaacattctccacagtatacttcatcgggatgtcaatactgactctttcagcatcagttcctatgctcatgcctccatcttgtgaaggatccttttgcccacaagcaagcccttttcagtatactgtatttttccttggtctttatctgattgccctgggtactggtggaattaagccttgtgtctcatcctttggagcggatcaatttgatgatacagatccagctgagcgaatccagaagggttctttctttaattggttctatttttcaataaacattggtgctctcatatcaagcagctttctggtttgggtgcaagacaatgtaggatggggactgggctttggcattccgactgtattcatggggctggcaatcataagtttcttctctggcacatcactttataggttccaaaaaccaggaggtagtcctattacacgagtatgccaggtgattgttgcctctttgcgcaagtggaatgtgcctgccccagaggacagctctctcttgtatgagctacctaatggggtatcaacaattgaggggagtcggcaaatagagcacacagatgaactcagatgtttagacaaggctgctacagttaccgaagttgatgtgaaaatggctgacttcagcaacccatggcggatatgcactgtcacccaggtggaagaactgaagatactagtaaggatgttccctgtctgggcaacaacaatagtgttttctgctgtatatgctcaaatgtcgacaatgttcgtggaacaagggatggtgcttgacccatcgttgggttctttcaagattcctccagcttcactgtctacctttgacaccctaagtgtcatcgtatgtgtcccgatgtacgattacattgtggttccaatagccaggagattcaccggcaacgagaggggctttacagagttgcagaggatgggcattggcctggtcatttccatccttgctatgtcggtcgctgcaatcctcgaaatcaagcggctagcagttgccagggaagcacacctggtggatcagaatgtcccggtcccactgagcatattctggcaaatccctcagtatttcctgattggtctagcagagattttcacattcatcggagcgcttgagttcttttatgaccagtcaccagacgccatgaggagcctctgcagtgcacttaatcttctcactactgcgggtgggaactatctcagcacgttcattttgacaatggtcgcgtactttactacgaggggaggtaaccctggatggattcctgacaacttgaacgaagggcatcttgattacttcttctggctccttgctggcctcagttttctgaacctgattgtatatgtcatctgtgctggcaaatacaagggcaagaaggcagcttga

SEQ ID NO: 291 - protein, 587 aa, Sorghum bicolor
  misc_feature (1)..(587): Ceres Annot ID no. 8633032
  misc_feature (1)..(587): Bit score of 941.5 for HMM based on sequences of Figure 6
  misc_feature (1)..(587): Functional Homolog Of SEQ ID NO. 209
  misc_feature (116)..(519): Pfam Name: PTR2 Pfam Description: POT family
MAGAERAEAVALEEGLLAPEESNQVVYTGDGSVDFSGNPVVKETTGRWKACPFILGNECCERLAYYGISTNLVTYLTKKLHAGNASAASNVTTWQGTCYLTPLIGAILADAYWGRYWTIATFSTVYFIGMSILTLSASVPMLMPPSCEGSFCPQASPFQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPAPEDSSLLYELPNGVSTIEGSRQIEHTDELRCLDKAATVTEVDVKMADFSNPWRICTVTQVEELKILVRMFPVWATTIVFSAVYAQMSTMFVEQGMVLDPSLGSFKIPPASLSTFDTLSVIVCVPMYDYIVVPIARRFTGNERGFTELQRMGIGLVISILAMSVAAILEIKRLAVAREAHLVDQNVPVPLSIFWQIPQYFLIGLAEIFTFIGALEFFYDQSPDAMRSLCSALNLLTTAGGNYLSTFILTMVAYFTTRGGNPGWIPDNLNEGHLDYFFWLLAGLSFLNLIVYVICAGKYKGKKAA

SEQ ID NO: 292 - protein, 570 aa, Vitis vinifera
  misc_feature (1)..(570): Public GI ID no. 157337654
  misc_feature (1)..(570): Bit score of 919.2 for HMM based on sequences of Figure 6
  misc_feature (1)..(570): Functional Homolog Of SEQ ID NO. 209
  misc_feature (88)..(484): Pfam Name: PTR2 Pfam Description: POT family
MMGAFQFQGFITGNATGGWKSASLLLANQGLATLAFFGVGVNLVLFLTRVLSQDNANAANSVSKWTGTVYLCSLIGAFLSDSYWGRYLTCAIFQVILVLGLLLLSLSSWLFLIEPKGCGDRTTLCSPSSSVGLGVFYSSIYLVAFGYGGHQPTLATLGADQFDETNPREMNSKTVFFSYFYFALNLGSLFSNTILVYFEDSGKWTLGFLVSTGSAIIALVIFLCGSSGYRHIKPCGNPLPRVAQVFVAAFRKWDVVVPENGDGLYELEGSESAIKGSRKILHSNEIEFLDKAATMIEADMVDPNPWRLCTVTQVEEAKCVIKMLPIWLCTIIYSVIFTQMASLFVEQGDVMNRKIGNFEIPAASMSAFDIFSVLLCTGIYRQILVPISGKLTGNPKGMSELQRMGIGLIIGIAAMIAAGLTELGRLRRVSPNEEASSLSIFWQTPQYVLVGASEVFMYVGQLEFFNGQAPDGIKSLGSSLCMASISLGNYVSSLLVNIVMGVTTRGDNPGWIPEDLNTGHLDRFYFLIAVLTVIDFVIYVFCAKWYKSINLESFEKKKDQEDGHAVDEGK

SEQ ID NO: 293 - DNA, 1770 bp, Sorghum bicolor
  misc_feature (1)..(1770): Ceres Annot ID no. 8642241
  misc_feature (1)..(1770): Encodes the peptide sequence at SEQ ID NO. 294
atggagtcatcgctggaggaggagcggcggcagaacctgctgctgcgcgcgacggagccgccagaggatcttgccgttgccgggtacacaggtgatggatcagttgactttagaggttttcctattttaaagcataacacagggaactggagagcatgttcattgattcttggaactgaaatatgtgaacgtttggcctactatggaatctcaaaaagtttggtcacttacctttcaacaaggctacatgaaggaaatgtctctgctgcgaggaacttcacaacctggcaaggaacttgttatcttacaccacttattggagcaaccttagcagattcgtactggggaaagtacaggactattgctgttttctccactatttactttcttgggatggcggcattgacactttcagcatcagttccttctttccagccccctcaatgtgttgggtctatttgtccacaaccgaccttacctcagtaccttatatactttgttggattatacatgattgctttgggagctggtggtataaagccatgtgtttcgtcctttggggctgaccaattcgatgatactgatccagttgagaaaacaaagaaaggcgctttcttcaattggttttatttctgcataaatattggttctttgatctctggcacagttcttatttgggtacaagagaattatggatatggcattggatttgggatccctacttttttcattgccttggctattggaagcttttttataggttcagaaaggtatagatttcagataccgggaggaagcccacttacaagagcatgtcaggtagttgtggcagccactcacaagcgaaaagcggatttgccagttgacagttctcttctctatgagctagatggtaagacttcagctattgaggggagtcgtaagctggagcacagtagtgaattcagtttccttgacaaagctgcagtcgttttgtggaatgaacatgatggttctcgcaatccatggagactttgcacagtcacacaagttgaagagcttaaaatattactgaggatgtttccaatctgggcaacaggaattgtgttcttcaccgtatgtgctcaaaactcatcgatgttcatagaacaagggatggccctcgataaccaaattggttctttcaagattccagcagcaactctgtcatccctagatgttatcagtattgttgtttgggttccaatttatgagagattagttgtgcccatagccaggagattcagtggaaaagagagaggtttctcagaacttcaacggatgggaattggtctatttgtatctacagttgcagtggcagttgcagcattagtcgagatcaagcgtctgcaggtcgcaagagcagaggatctggttcatcagaaggtacctgttcctatgagcatcctttggcaagcaccacagtacttgctggttggcgtgggcgaggtgttcacatcaatcggtcaagctgagtttttctacaatcagtcaccagacgccatgagaagcctatgctcagctttcgctcttgttaccgtgtcacttggaagttatctcagctcattcatcttgaccctggtgtcatatttcacaactcgaaatgggcaattggggtggatccctgataacttaaacgaaggccatcttgaccgttttttctggctgatagctggtctcagctctttaaatttccttgtttttatatattacgctcaacaatacaagtgcaagagagcctctgttgcttaa

SEQ ID NO: 294 - protein, 589 aa, Sorghum bicolor
  misc_feature (1)..(589): Ceres Annot ID no. 8642241
  misc_feature (1)..(589): Bit score of 844.7 for HMM based on sequences of Figure 6
  misc_feature (1)..(589): Functional Homolog Of SEQ ID NO. 209
  misc_feature (118)..(518): Pfam Name: PTR2 Pfam Description: POT family
MESSLEEERRQNLLLRATEPPEDLAVAGYTGDGSVDFRGFPILKHNTGNWRACSLILGTEICERLAYYGISKSLVTYLSTRLHEGNVSAARNFTTWQGTCYLTPLIGATLADSYWGKYRTIAVFSTIYFLGMAALTLSASVPSFQPPQCVGSICPQPTLPQYLIYFVGLYMIALGAGGIKPCVSSFGADQFDDTDPVEKTKKGAFFNWFYFCINIGSLISGTVLIWVQENYGYGIGFGIPTFFIALAIGSFFIGSERYRFQIPGGSPLTRACQVVVAATHKRKADLPVDSSLLYELDGKTSAIEGSRKLEHSSEFSFLDKAAVVLWNEHDGSRNPWRLCTVTQVEELKILLRMFPIWATGIVFFTVCAQNSSMFIEQGMALDNQIGSFKIPAATLSSLDVISIVVWVPIYERLVVPIARRFSGKERGFSELQRMGIGLFVSTVAVAVAALVEIKRLQVARAEDLVHQKVPVPMSILWQAPQYLLVGVGEVFTSIGQAEFFYNQSPDAMRSLCSAFALVTVSLGSYLSSFILTLVSYFTTRNGQLGWIPDNLNEGHLDRFFWLIAGLSSLNFLVFIYYAQQYKCKRASVA

SEQ ID NO: 295 - DNA, 1734 bp, Populus trichocarpa
  misc_feature (1)..(1734): Ceres Annot ID no. 1520085
  misc_feature (1)..(1734): Encodes the peptide sequence at SEQ ID NO. 296
atgaacaaaaataatggactccacacaggagatggctcggtcgacattaatgggacggctgttcttaagcagaaaactggaaattggagagcatgctctttcatattgggaaatgaatgctgtgaacgcttggcctactatggaattgctactaatctggtctcctaccttactgggaagctacatgaaggaaatgtgtcagctgcaaaaaatgttaacatttgggcaggaacttgctacttcacaccactcattggagccactttggcagatgcttattggggaagatattggaccatttctgttttctccacaatttacttcattggaatgtgtacgttgactctctcagcaactattcctgtattaaagccagctgaatgtataggttctctatgccctccagcaactcctgctcagtatggggtattcttttttggcctctatctgattgcatttgggacaggtggcatcaaaccatgtgtttcatcctttggggcggatcagtttgatgacactgatcctaaggaaagggtaaagaaggggtccttcttcaattgtttctatttttcaatcaacattggttgtcttgtatcaagtagtttaatggtatacattcaagacaaagctgggtgggggctaggatttggaattcctgcattgttcatgggcatagctattgctatcttcttttcaggcacgcccctttatagatttcagaggccagtggggagcccaattactagaatgtgccaagttgtggttgcgtcattccataagaggaatttggaggttccccaagacattagtctcctatatgaaacccaagaaaaacactcaaccattgagggaacctggaaactagcgcacagcaatgaattgaaatgccttgataaagctgctataatttcagaggctgagataaaaggtggggacttcagtgatccatggaggctttgtactatgactcaggtggaggaattgaagattttgatccgcatgtttccgatctgggctacaggcattgtcttttctgctgcccatgcccaaatgagtacaatctttgtggaacaagggatgctgatggacaagacaattggttctttcaacatccctcctgcttctatgatcacaattgatgttattagtgttattttctgggttccaatctatgataggatcattgttccaattgcaaggaagttcactggcagagagaggggcttttcagagttgcagcgtatgggaattggcttgttcatttctatgctatcaatgacagctgctgctttgctagagattaagcgcttgcagcttgtaaaagagcttggattggttggtgatgctgttgcagttcctctcagtatcttgtggcaaattccccagtatatgttgatgggtacagcagagatctttacatccattggtcagcttgaatttttctatgaacagtctccagatgccatgcggagtctatgcagtgctttgtcactcctggctgcatctttgggtaattacctgagctcttttattctgagcatggtaacttacctcacaaccacgggtgggaagacaggatggataccagataacttaaataaggggcaccttgattatttattctggcttttggctgggctcagcttcttcaacttgctgatctacactatttgtgcaaagagatttataaagagaagaaggcctcctaaggtttttacaagaggggaggcctag

SEQ ID NO: 296 - protein, 577 aa, Populus trichocarpa
  misc_feature (1)..(577): Ceres Annot ID no. 1520085
  misc_feature (1)..(577): Bit score of 898.9 for HMM based on sequences of Figure 6
  misc_feature (1)..(577): Functional Homolog Of SEQ ID NO. 209
  misc_feature (97)..(500): Pfam Name: PTR2 Pfam Description: POT family
MNKNNGLHTGDGSVDINGTAVLKQKTGNWRACSFILGNECCERLAYYGIATNLVSYLTGKLHEGNVSAAKNVNIWAGTCYFTPLIGATLADAYWGRYWTISVFSTIYFIGMCTLTLSATIPVLKPAECIGSLCPPATPAQYGVFFFGLYLIAFGTGGIKPCVSSFGADQFDDTDPKERVKKGSFFNCFYFSINIGCLVSSSLMVYIQDKAGWGLGFGIPALFMGIAIAIFFSGTPLYRFQRPVGSPITRMCQVVVASFHKRNLEVPQDISLLYETQEKHSTIEGTWKLAHSNELKCLDKAAIISEAEIKGGDFSDPWRLCTMTQVEELKILIRMFPIWATGIVFSAAHAQMSTIFVEQGMLMDKTIGSFNIPPASMITIDVISVIFWVPIYDRIIVPIARKFTGRERGFSELQRMGIGLFISMLSMTAAALLEIKRLQLVKELGLVGDAVAVPLSILWQIPQYMLMGTAEIFTSIGQLEFFYEQSPDAMRSLCSALSLLAASLGNYLSSFILSMVTYLTTTGGKTGWIPDNLNKGHLDYLFWLLAGLSFFNLLIYTICAKRFIKRRRPPKVFTRGEA

SEQ ID NO: 297 - DNA, 1713 bp, Populus trichocarpa
  misc_feature (1)..(1713): Ceres Annot ID no. 1514979
  misc_feature (1)..(1713): Encodes the peptide sequence at SEQ ID NO. 298
atggcagaggaggatgtttatacaaaagatggaactgtggattatctggggaatcctgctaacagaaaggagactggaacctggagggcctgcccttttattataggaaatgaattttgtgaacgattggcgtactatgggatgagctccaatctggttctttatttcaagcacagactgaaccagagcagtgctacagctactagaaataacttgaactggggtggaacatgctatctcactccattgatcggagcattcgttgctgatgcttatctaggaagatattggacgattgctagtttctcaaccatttatgttgcagggatgacgcttttgacaatgtcagcaactgtccatggcctcaggccagaatgttattcaaaagatcattgccatccaacaggtggtcaaactgctgtaactttcgtagcactttacctgatagcacttggcacaggaggtattaagccttgtgtctcatcctatggagcagatcagtttgatgatgctgacgaaactgagaagaaacacaagagttcattctttaactggttctacctctcgattaatgttggtgctcttattgccggttctgtgctggtttggatacaagataatgtgagttggggatggggttttggcattccagcaatagccatggcaattgctgttgtgagcttcttttcaggtaccaagttgttcaggtatcaaaagcctggaggcagccctcttacacgcatctgtcaggtgctggtggcatccttcagaaaacagaaagttgaagttcctgctgacaagtctctgttgcatgagactgcagatgccgaatccaacatcaaaggaagccgcaagctcgaccatactgaagaatttagtttccttgacaaggcagcagtagaaacagaaaaggacgacataaaagggacaggagacccatggaatctttgcacagtaacccaggtcgaggagctaaaggctatcattcggttgcttcctatatgggccactggtatcatcttttctgcagtgtacagccaaatggggaacttatttgtgctgcaaggtgaaacaatggataaatttgttggaaactccactttcgagataccatctgcatctttatccatctttgacacccttagtgtcattttttgggtccctgtgtatgaccgaattatcgtcccagttgcaagaaaattcactggacataaaaacggcttaactcaactgcagcggatgggcattggtctattcatatcaatatttgccatggtatctgcagcaatcttggaacttaaaagactgcaaatggtgagaaataacaactactacgaacttgattccgtgcccatttctatattttggcaagttccacagtatttcctgataggctgtgccgaagttttcacgttcatcggacaattggaattcttctacgaacaagcacctgatgcaatgaggagcatgtgttctgccctgtcactcaccaccgtcgcacttggcaattacttaagctctcttctggtaaccattgttacaaccatcagcactaagaatggaaaggctggatggattccggacaacttaaattacggtcacattgattacttcttctggctactaggaatgctcagtgtgctgaatttaggtgcctttctcttgatctcaaattggtacacttataaaaaggctataggaactcttcgttga

SEQ ID NO: 298 - protein, 570 aa, Populus trichocarpa
  misc_feature (1)..(570): Ceres Annot ID no. 1514979
  misc_feature (1)..(570): Bit score of 881.1 for HMM based on sequences of Figure 6
  misc_feature (1)..(570): Functional Homolog Of SEQ ID NO. 209
  misc_feature (96)..(498): Pfam Name: PTR2 Pfam Description: POT family
MAEEDVYTKDGTVDYLGNPANRKETGTWRACPFIIGNEFCERLAYYGMSSNLVLYFKHRLNQSSATATRNNLNWGGTCYLTPLIGAFVADAYLGRYWTIASFSTIYVAGMTLLTMSATVHGLRPECYSKDHCHPTGGQTAVTFVALYLIALGTGGIKPCVSSYGADQFDDADETEKKHKSSFFNWFYLSINVGALIAGSVLVWIQDNVSWGWGFGIPAIAMAIAVVSFFSGTKLFRYQKPGGSPLTRICQVLVASFRKQKVEVPADKSLLHETADAESNIKGSRKLDHTEEFSFLDKAAVETEKDDIKGTGDPWNLCTVTQVEELKAIIRLLPIWATGIIFSAVYSQMGNLFVLQGETMDKFVGNSTFEIPSASLSIFDTLSVIFWVPVYDRIIVPVARKFTGHKNGLTQLQRMGIGLFISIFAMVSAAILELKRLQMVRNNNYYELDSVPISIFWQVPQYFLIGCAEVFTFIGQLEFFYEQAPDAMRSMCSALSLTTVALGNYLSSLLVTIVTTISTKNGKAGWIPDNLNYGHIDYFFWLLGMLSVLNLGAFLLISNWYTYKKAIGTLR

SEQ ID NO: 299 - protein, 587 aa, Vitis vinifera
  misc_feature (1)..(587): Public GI ID no. 147858202
  misc_feature (1)..(587): Bit score of 1031.1 for HMM based on sequences of Figure 6
  misc_feature (1)..(587): Functional Homolog Of SEQ ID NO. 209
  misc_feature (113)..(520): Pfam Name: PTR2 Pfam Description: POT family
MASMACLNIFQKGRGKTRNEQEECTFDGSVDRHGHPAVRARTGNWVTAILILVNQGLATLAFFGVGVNLVLFLTRVLGQDNATAANNVSKWTGTVYIFSLLGAFLSDSYWGRYKTCAIFQVIFVIGLVLLSLSSYIFLLKPNGCGDKEFPCGSHSTFEISFFYLSIYLIALGNGGYQPNIATFGADQFDEDNPKESHSKVAFFSYFYLALNLGSLFSNTILGYFEDGGRWVLGFWASSASAILALILFLFGIPRYRHFKPSGNPLSRFCRVVVAATRKWKVEMPPEGEDLYEVDGDDCSGNCRRKMLHTQGFKFLDKAAVLTAKEREQEDKESRSPWRICTVTQVEEVKCILRLLPIWLCTILYSVVFTQMASLFVEQGAAMKTTLLGFHIPPASMSSFDIVSVAAFIFIYRRVLDPLVARLKGTKARGLTELQRMGIGLIIAIIAMVAAGIVEWFRLKYAKKDCRQCESESSLSIFWQIPQYVLIGASEVFMYVGQLEFFNDQAPDGLKSFGSALCMTSISLGNYVSSLLVTIVMKFSTRDQMPGWIPSNLNKGHLDRFYFLLAALTMADFGVYIICAKVVTSPSS

SEQ ID NO: 300 - protein, 574 aa, Oryza sativa
  misc_feature (1)..(574): Public GI ID no. 125545538
  misc_feature (1)..(574): Oryza sativa Indica Group
  misc_feature (1)..(574): Bit score of 878.8 for HMM based on sequences of Figure 6
  misc_feature (1)..(574): Functional Homolog Of SEQ ID NO. 209
  misc_feature (122)..(506): Pfam Name: PTR2 Pfam Description: POT family
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 301 - protein, 591 aa, Oryza sativa
  misc_feature (1)..(591): Public GI ID no. 115451771
  misc_feature (1)..(591): Oryza sativa Japonica Group
  misc_feature (1)..(591): Bit score of 886.1 for HMM based on sequences of Figure 6
  misc_feature (1)..(591): Functional Homolog Of SEQ ID NO. 209
  misc_feature (121)..(523): Pfam Name: PTR2 Pfam Description: POT family
MEEAAEDRRLQVREEGGDQEPLLLLPQDANLYTGDGSVDIKGRPALKHATGNWRACFFILGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNAVYAHNSSMFIEQGMVLDKRVGSFIVPPASLSTFDVISVIIWIPFYGRVLVPIARKFTGREKGFSELQRIGIGLALSILAMLSAALVELRRLGIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 302 - protein, 574 aa, Oryza sativa
  misc_feature (1)..(574): Public GI ID no. 125587732
  misc_feature (1)..(574): Oryza sativa Japonica Group
  misc_feature (1)..(574): Bit score of 529.8 for HMM based on sequences of Figure 6
  misc_feature (1)..(574): Functional Homolog Of SEQ ID NO. 209
  misc_feature (122)..(506): Pfam Name: PTR2 Pfam Description: POT family
MAEVTVVRAEPQEGSTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 303 - DNA, 1755 bp, Populus trichocarpa
  misc_feature (1)..(1755): Ceres Annot ID no. 1516968
  misc_feature (1)..(1755): Encodes the peptide sequence at SEQ ID NO. 304
atggctaagattaacaagtatccagtccttgtcagtttcgtattatatttccaggatgaaagcaatggactctacacaggagatggctcagttgacattaatgggaaccctgtccttaagcagaaaactggaaactggaaagcatgccctttcatactgggtactgaatgttgtgaacgcctggcctactatgggattgctactaatctcgtcacttaccttaccaagaagctacatgaaggaaatgtgtcggctgcaagaaatgttaccacctggtcagggacatgctatcttacacccctcatcggagctgtattagcagatacttgttggggaagatattggactattgctgctttctcctcaatttacttcattggaatgtgtgcgttgactctctcagcatctattcctgcattaaagccagctgaatgcgtaggttctctgtgccctccagcaactccagctcagtatgcagtattcttttttggcctctatctgattgcgcttgggacgggtggcatcaaaccatgtgtttcatcctttggggcagatcaatttgatgacactgatcccaaggaacgggtaaagaagggatctttcttcaattggttctatttttcaatcaatattggtgctcttatatcaagtagttttctggtatatattcaagacaatgccggttggggactaggatttggaattcctgcactgttcatgggcatagctattgctagcttcttttcaggcacacccctttacagatttcaaagaccaggggggagccctattacaaggatgtgccaagttttggttgcatcattccataagtggaatctggaggttcctctagacagtagcctcctgtatgaaacacaagacaaacactctgccattgaaggaagccggaaactggtgcacagcgatgaactaaagtgccttgataaagctgctgtgctgtcagaggctgagatgaaaagtggggacttccccaacccttggaggctttgtactgtcacgcaggtggaggaattgaagattttgatccgcatgtttccaatctgggctacaggaattgtcttttccgctgtgtatgcccagatgtctactatgtttgtggaacaagggatgctgatggacacgacaattggttctttcacaattcctccagcatctctgtcatcctttgatgttattagtgttatttgctgggtgccaatctatgataggattgttgttcccattgcaaggaagttcacaggaaaagagaggggcttctcagatttgcagcgtatgggaattggcctgttcatttcagtgttatcaatgacagctgctgctttggtggagattaagcgcctacagcttgcgaaagagcttggcttggctggtgaagctgttgcagtgcctatcagtattttttggcagatcccccaatatatgttggtaggtgcttcagaagtttttacattcattggtcagattgaattcttctatgaagaatctccagatgcaatgcggagtttatgcagtgcgttgtcactcctgactacgtctttgggtaattacttgagctcttttattctgactatggtaacttacttcacaaccacgggtgggaagccaggatggatccccgataacttgaatgagggccacctcgattatttcttctggcttttagctggactcagcgttctcaacatgctggtctatgttttctgtgcgaggaaatataagcagaaggcctcctaa

SEQ ID NO: 304 - protein, 584 aa, Populus trichocarpa
  misc_feature (1)..(584): Ceres Annot ID no. 1516968
  misc_feature (1)..(584): Bit score of 961.7 for HMM based on sequences of Figure 6
  misc_feature (1)..(584): Functional Homolog Of SEQ ID NO. 209
  misc_feature (114)..(517): Pfam Name: PTR2 Pfam Description: POT family
MAKINKYPVLVSFVLYFQDESNGLYTGDGSVDINGNPVLKQKTGNWKACPFILGTECCERLAYYGIATNLVTYLTKKLHEGNVSAARNVTTWSGTCYLTPLIGAVLADTCWGRYWTIAAFSSIYFIGMCALTLSASIPALKPAECVGSLCPPATPAQYAVFFFGLYLIALGTGGIKPCVSSFGADQFDDTDPKERVKKGSFFNWFYFSINIGALISSSFLVYIQDNAGWGLGFGIPALFMGIAIASFFSGTPLYRFQRPGGSPITRMCQVLVASFHKWNLEVPLDSSLLYETQDKHSAIEGSRKLVHSDELKCLDKAAVLSEAEMKSGDFPNPWRLCTVTQVEELKILIRMFPIWATGIVFSAVYAQMSTMFVEQGMLMDTTIGSFTIPPASLSSFDVISVICWVPIYDRIVVPIARKFTGKERGFSDLQRMGIGLFISVLSMTAAALVEIKRLQLAKELGLAGEAVAVPISIFWQIPQYMLVGASEVFTFIGQIEFFYEESPDAMRSLCSALSLLTTSLGNYLSSFILTMVTYFTTTGGKPGWIPDNLNEGHLDYFFWLLAGLSVLNMLVYVFCARKYKQKAS

SEQ ID NO: 305 - DNA, 2464 bp, Zea mays
  misc_feature (1)..(2464): Ceres Clone ID no. 350844
  misc_feature (1)..(2464): Encodes the peptide sequence at SEQ ID NO. 306
atcggagctctataaatcgccccaaccccctccctcgttctgccaccattgccatatcctcgatcacaagagcagctactagctgcctctagctcgatcggttagtttgtcgtgttgcttacgtacgtcagcagaggccatcgtcgagtgtatccagtggtcgagaagagggaagaaatgtctgcgaacgacggcgccggcgacacgaagatgagggcgatcgtcgtcgtagaggaaggggagatgagcgcgccggcggcgacgccgaagcagggcaagtgctgcgagtacacgctggacggctccgtcgacatgaagggccggccggcggtcaaggggaaatcaggagggtggcttgccggtgctctaatcctcgtgaaccagggcctggcgacgctggctttcttcggcgtgaacgtgaacctggtgctgttcctgacccgggtgctggggcagagcaatggcgacgccgccaacaacgtcagcaagtggacgggcaccgtgtacatgttctccctcatcggcgccttcctcagcgactcctattggggacgctacaagacctgcgccatcttccaggccatctttgtcctcggcctcgcgctgctgtcggtgtcgtcgcacctctacctaatcaggccggacgggtgcggcatggagcacgcgccctgcggcccgcactccggcaaggagctggggatcttctacatcgcgctgtacatgatcgccttcggcaacggcgggtaccagcccaacatcgccaccctgggcgccgaccagttcgacgaggaggaccccgccgaggcgcactccaaggtctccttcttcagctacttctacctcgccctcaacctcggctcgctcttctccaacaccttcctcagctacctcgaggacaagggcagctgggcgctcggcttctgggcctccaccgccgccgccgccacagcgctcctgcttttcctcagcggcacgctccggtaccgctatttccagcccggagggaacccgatcggaaggattggccaggtcgccatcgccgcgtgcaggaactggaaggcgggcgtgtcgaccgaagtggtaagcctgtacgagggcgacgagaaggcggatgccggtggcaggaagcttctgcacacgcaagggttcagtttcttggaccgcgcggcgcacgcggacactgactccaagctcggcgcgcgcgatccctggaagctgtgctcggtgacgcaggtggaggaggtcaagagcatcctgaggctcctccccatctggctctgcaccatcctctactccgttgtcttcacccagatggcctcgctctttgtcgtgcagggcgccgcgatgcgccgcaccaccccgttctccggcttctccgtcccgccctccagcatgtcggccttcgacattctcacagtcgccgccacgattttcctgtaccgccgcactatctgcccgttcctagcgcggctcagcggccgcccggctggccccaccgagctgcagaggatgggcctcggcctggtcgtgggtgccctggccatgaccacggccgggacggtcgagcacttccggaaggccagggccaccgcagcgatgagcagcgacctgcatatcatgtggcaggtgccgcagtatgcgctgatcggcgtgtcggaggtgatgatgtacgtcgggcagctcgagttcttcaacggccagatgcccgacgggctcaaaagcttcggagcgcgctgtgcatgatgtccatgtcgctcggcaactacttcagtgacatcatcgtgagcgcggtgaccaggctcaccacgacgcgagggcggtccgggtggatcccggctgacctcaacgaggggcacctcgacaagttctacttcctgctcgccgtgctggccgtcgcggacttcgcggtgtacctcgtatgcgcgagccgctacgggagcggcaaagtggacgggaggagcagcgacgacgaggaggagggagcggccggtcaggtgacatccccggcttacgcatgaccatcaccggccgcccggccggcgggcatcgtacgtatgttgttcttgtcttcttgaggtggaggctggcaggctgcaaatctcgagggccattggttatttggttgacggagttcttccattgacgacgatagcacaagcatggggcgagcatggacatagtgatatgactaattaaagaataagcacttaagcaggactagctaaacactacatgctgcagcatcatgctcgcggtttttggccagtgtaacaacagacgacgattgttactgaccacgactgttctttgcgtggtctacagagttcgcttctgcaaaattcaataatgggcgagtgctgtatcatataaagtcgcaggttgcgccacgtagctacgatgtgactaacaaacaaatatgtattcaagttatgtattaaacggttaaccgtgtctttttaccgtt

SEQ ID NO: 306 - protein, 613 aa, Zea mays
  misc_feature (1)..(613): Ceres Clone ID no. 350844
  misc_feature (1)..(613): Bit score of 961.1 for HMM based on sequences of Figure 6
  misc_feature (1)..(613): Functional Homolog Of SEQ ID NO. 209
  misc_feature (127)..(523): Pfam Name: PTR2 Pfam Description: POT family
MSANDGAGDTKMRAIVVVEEGEMSAPAATPKQGKCCEYTLDGSVDMKGRPAVKGKSGGWLAGALILVNQGLATLAFFGVNVNLVLFLTRVLGQSNGDAANNVSKWTGTVYMFSLIGAFLSDSYWGRYKTCAIFQAIFVLGLALLSVSSHLYLIRPDGCGMEHAPCGPHSGKELGIFYIALYMIAFGNGGYQPNIATLGADQFDEEDPAEAHSKVSFFSYFYLALNLGSLFSNTFLSYLEDKGSWALGFWASTAAAATALLLFLSGTLRYRYFQPGGNPIGRIGQVAIAACRNWKAGVSTEVVSLYEGDEKADAGGRKLLHTQGFSFLDRAAHADTDSKLGARDPWKLCSVTQVEEVKSILRLLPIWLCTILYSVVFTQMASLFVVQGAAMRRTTPFSGFSVPPSSMSAFDILTVAATIFLYRRTICPFLARLSGRPAGPTELQRMGLGLVVGALAMTTAGTVEHFRKARATAAMSSDLHIMWQVPQYALIGVSEVMMYVGQLEFFNGQMPDGLKSFGSALCMMSMSLGNYFSDIIVSAVTRLTTTRGRSGWIPADLNEGHLDKFYFLLAVLAVADFAVYLVCASRYGSGKVDGRSSDDEEEGAAGQVTSPAYA

SEQ ID NO: 307 - DNA, 1746 bp, Sorghum bicolor
  misc_feature (1)..(1746): Ceres Annot ID no. 8658700
  misc_feature (1)..(1746): Encodes the peptide sequence at SEQ ID NO. 308
atgggagaggtcgcggacatgtacacccaagacgggacggtggacaggaaggggaatcccgccctgaagaaggacaccggcaactggagggcatgcccctacatcctcgcgaacgagtgctgcgagaggctggcctactatggcatgagcaccaaccttgttcactacatgaagacccggcttggccaggtgaacagcgtcgcctccaacaacgtcaccaactggtcagggacgtgctacatcacgccactcatcggcgccttcttcgccgacgcgtacctggggaggttctggaccatcgccagcttcatggtcatctacattttcggactggcgctgctgacgatggcgtcgtcggtgaaggggctggtgcctacgtcgtgtgacaatgacggcgtgtgccacccgacggacgcgcagtcggcggtggtgttcgtggcgctgtacctgatcgcgctgggaacgggcgggatcaagccctgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacatcggctggggctggggcttcggcatccccgccgtggtcatggccatcgccgtcgtcagcttcttcgtgggcacgccgctgtacaggcaccagaagcccggtggcagcccgctgacgcgcatcgcgcaggtgctcgtcgcgtgcgcgcgcaagtggaacgtggccgtgcccgccgacaagtcgcgcctccacgagacgctggacaaggagtccggcatcgagggcagccgcaagctggagcacacggaccagctcgcgtgcctcgacagggctgccgtcgtgacggccgaggacagcgccgcgggggcggcgacggcgacgagcccgtggcgcctgtgcacggtgacgcaggtggaggagctcaagagcgtgatccggctgctccccatctgggcgagcgggatcgtgttcgcggcggtgtactcgcagatgagcaccatgttcatcctccagggcgacacgctggaccagcgcatggggtccaagttcaagatcccctcggcgacgctctccatggtggacaccatcagcgtcatcttctgggtgcccgtctacgaccgcgtcatcgtgcccgtcgtgcgctcctacaccggccgtccccgagggttcacgcagctgcagcggatgggcatcggcctcgtcgtctccatcttctccatggtggcggcgggcgtgctggacatcgtgcggctgaacgccgtggcgcggcacggcctgtacggcaaggacgaccacgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtgctggtgaccatcgtcacgcacatcaccaccaggaacggcaacatcgggtggatcccggagaacctcaaccggggccacctcgactacttcttctggctgctcgccgtgctcagcctcctcaacttcctcgtctacctcgtcatcgccacctggtacaagtacaagaagacggccgatgatatcccggacgccaaaggggagcactga

SEQ ID NO: 308 - protein, 581 aa, Sorghum bicolor
  misc_feature (1)..(581): Ceres Annot ID no. 8658700
  misc_feature (1)..(581): Bit score of 926.7 for HMM based on sequences of Figure 6
  misc_feature (1)..(581): Functional Homolog Of SEQ ID NO. 209
  misc_feature (97)..(503): Pfam Name: PTR2 Pfam Description: POT family
MGEVADMYTQDGTVDRKGNPALKKDTGNWRACPYILANECCERLAYYGMSTNLVHYMKTRLGQVNSVASNNVTNWSGTCYITPLIGAFFADAYLGRFWTIASFMVIYIFGLALLTMASSVKGLVPTSCDNDGVCHPTDAQSAVVFVALYLIALGTGGIKPCVSSFGADQFDENDEREKKSKSSFFNWFYFSINIGALVASTVLVYVQTHIGWGWGFGIPAVVMAIAVVSFFVGTPLYRHQKPGGSPLTRIAQVLVACARKWNVAVPADKSRLHETLDKESGIEGSRKLEHTDQLACLDRAAVVTAEDSAAGAATATSPWRLCTVTQVEELKSVIRLLPIWASGIVFAAVYSQMSTMFILQGDTLDQRMGSKFKIPSATLSMVDTISVIFWVPVYDRVIVPVVRSYTGRPRGFTQLQRMGIGLVVSIFSMVAAGVLDIVRLNAVARHGLYGKDDHVPISIFWQIPQYFIIGCAEVFTFVGQLEFFYDQAPDAMRSMCSALSLTTVALGNYLSTVLVTIVTHITTRNGNIGWIPENLNRGHLDYFFWLLAVLSLLNFLVYLVIATWYKYKKTADDIPDAKGEH

SEQ ID NO: 309 - protein, 559 aa, Vitis vinifera
  misc_feature (1)..(559): Public GI ID no. 157346088
  misc_feature (1)..(559): Bit score of 871.2 for HMM based on sequences of Figure 6
  misc_feature (1)..(559): Functional Homolog Of SEQ ID NO. 209
  misc_feature (96)..(487): Pfam Name: PTR2 Pfam Description: POT family
MAEEDIYTKDGTIDFRSNPAVKKETGTWKACPYILGNECCERLAYYGINTNLVNYLKFQLNQRNVVAINNVTNWSGTCYVTPLLGAFLADAYLGRYWTIAGFSIIYVFGMTLLTLSASAHGLKPLCDGQNVCYPTGLQTAVFFVGLYLIALGTGGIKPCVSSFGADQFDDSDETERKSKSSFFNWFYFSINIGALLASSVLVWVQTNVGWGWGFGIPAVAMGIAVMSFFSGTRLYRNQKPGGSPLTRICQVIVASLRKFQVEVPADKCLLYETADSESAVTGSRKLDHTKHLSFFDKAAVETHIDAIKGSVDSWRLCTVTQVEELKSIIRLLPIWATGIVFSAVYSQMGTLFVLQGNTMDLHITGSFQIPSASLSLFDTISVIFWVPIYDRLIVPFARKFTGHKSGFTQLQRIAIGLVISIFAMLVAGTLELLRLRMHIPMSIFWQVPQYFIIGCAEVFTFIGQLEFFYEQAPDAMRSLCSALSLTTAALGNYLSTLLVNVVTDVSTRGGKPGWIPDNLNYGHLHYFFWLLAALSVFNLGVYLQVARWYTYKRTAVDSL

SEQ ID NO: 310 - DNA, 2110 bp, Gossypium hirsutum
  misc_feature (1)..(2110): Ceres Clone ID no. 1926916
  misc_feature (1)..(2110): Encodes the peptide sequence at SEQ ID NO. 311
aacattccactccttcagcttgtgttaatatctaatcaaccaaattttaaggatcccagaacttctttttctttttcctttttgttaaaagattccaaaagttgttgacattaccaatctaacaagttgcaaaacaatcatgggatctatggatgaagagagatcgcttttggaagctgaacttaatcaggctgaaagcagtgggctttacactggggatggctccgttgacttcaatgggaatcctattttgaagcagaatactggaaattggagagcgtgccctttcattttgggtaatgaatgctgtgagagattggcttattatgggatagcaactaatcttgtaagttacctgaccaagaaactgcatgaagggaatgtatcagctgcaagaaatgtaactacttggcaaggaacttgctaccttacacctctcattggagccgtcttagcagatgcatattggggaagatattggacaattgctgctttctccactatttacttcttcggaatgtgtacattgactctctcagcatcaattcctgcactgaaacctgctgaatgtgtgggttctatttgtccctcagctactccagctcagtatgctgtatttttctttgggctttatctgattgcattagggacgggtggaatcaaaccgtgtgtttcatcctttggggccgatcagtttgatgatactgatcccaatgaaagggtgaagaaggggtcctttttcaactggttctatttttccatcaacattggtgctctgatctcaagcagtcttctggtgtggattcaggacaatgctggatggggtcttggatttggcattccagcattgtttatgggccttgcaattggaagttttttctcaggcacggcactctatagatttcaaagaccaggaggaagccctattacaagaatgttccaggttttggttgcagcatttcataaacggagcctcaaggtacctgaagacagtactctcctatatgaaactggtgacaagcactctgccatagaaggaagtcggaaactagagcacagtgaggagttgaagtgcctagataaagctgccatagtcactgatgttgaaaccaaaagtggggacttctcaaatccttggaggctttgcactgtaacacaagtggaggaattgaaaatcttgatccgcatgtttcccatatgggctactggaattgtgttctctgctgtatatgctcaaatgtcaactatgtttgtggaacaagggatgatgatggacacaaaaattggttctttcactattcctcctgcttctctctcaacttttgatgttattagtgttattttttgggtccccatctatgataggatcattgtcccaattgcaagaaagttcacacgtaaggagcgaggcttctcagagttgcagcgtatgggaattggtctttttatttcagtcctatgcatgtcagccgcagctgtggtggagaccaggagattgcaccttgctaaagagctagatttggtcgataagcaggtcgctgtacccattagtattctttggcaaatacctcaatatttcttgttgggtgccgcagaggtctgcacatttatcggacagcttgagttcttctatgatcagtcccctgatgccatgcggagtttatgtagtgcgctttcacttctgactacatctttaggcaattacctgagttcttttattctaactcttgtaacttacttcacaacaaagggtggccagattggttggatatcggacaaccttaacgagggtcatctcgactatttcttctggctcttggctggtctcagcttcttaaacatgttggtgtataccctttgtgcttcgaggtacaagcagaagaaggcttcctaaagttccttctcatatggagagaaattaagctgaaatgttgttatagataaaaactgtatgcatctcaatacagggacatccttccactttggaaaccaactatcttgtatcttattgggttatattcattttctagctgattctcgcatattgtacattaatactgcatggttttcaattatttgccatccttaaatgtcggattaaattgtttgc

SEQ ID NO: 311 - protein, 584 aa, Gossypium hirsutum
  misc_feature (1)..(584): Ceres Clone ID no. 1926916
  misc_feature (1)..(584): Bit score of 956.4 for HMM based on sequences of Figure 6
  misc_feature (1)..(584): Functional Homolog Of SEQ ID NO. 209
  misc_feature (113)..(516): Pfam Name: PTR2 Pfam Description: POT family
MGSMDEERSLLEAELNQAESSGLYTGDGSVDFNGNPILKQNTGNWRACPFILGNECCERLAYYGIATNLVSYLTKKLHEGNVSAARNVTTWQGTCYLTPLIGAVLADAYWGRYWTIAAFSTIYFFGMCTLTLSASIPALKPAECVGSICPSATPAQYAVFFFGLYLIALGTGGIKPCVSSFGADQFDDTDPNERVKKGSFFNWFYFSINIGALISSSLLVWIQDNAGWGLGFGIPALFMGLAIGSFFSGTALYRFQRPGGSPITRMFQVLVAAFHKRSLKVPEDSTLLYETGDKHSAIEGSRKLEHSEELKCLDKAAIVTDVETKSGDFSNPWRLCTVTQVEELKILIRMFPIWATGIVFSAVYAQMSTMFVEQGMMMDTKIGSFTIPPASLSTFDVISVIFWVPIYDRIIVPIARKFTRKERGFSELQRMGIGLFISVLCMSAAAVVETRRLHLAKELDLVDKQVAVPISILWQIPQYFLLGAAEVCTFIGQLEFFYDQSPDAMRSLCSALSLLTTSLGNYLSSFILTLVTYFTTKGGQIGWISDNLNEGHLDYFFWLLAGLSFLNMLVYTLCASRYKQKKAS

SEQ ID NO: 312 - protein, 585 aa, Arabidopsis thaliana
  misc_feature (1)..(585): Public GI ID no. 15226861
  misc_feature (1)..(585): Bit score of 915.4 for HMM based on sequences of Figure 6
  misc_feature (1)..(585): Functional Homolog Of SEQ ID NO. 209
  misc_feature (113)..(516): Pfam Name: PTR2 Pfam Description: POT family
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 313 - DNA, 2216 bp, Triticum aestivum
  misc_feature (1)..(2216): Ceres Clone ID no. 816960
  misc_feature (1)..(2216): Encodes the peptide sequence at SEQ ID NO. 314
aaaatccaaaggtggctgtggctgtggctcacacacacacacacagagagagacaagagacagcgagtcacagaccgagggagggggagctcagaccaggccagcgggaatcgcgcgcgcgggccgggcgacgactgaggcggagatcccttccgaccggccgccgccgccgctcgtcgacaccgaccaacagaggaagcagttcctctgagttgctgcagcgcgtagtctgagagacaagcaagtacagcagccatgggggaggtcgcggcggagctgtacacccaggatggcaccatcgacatcaagggcaacccggccctcaagagcaacaccggcaactggcgagcatgcccctacatcctcgcgaacgagtgctgcgagcgccttgcctactacggcatgagcaccaacctggtcaacttcatgaaggaccggatgggcatggccaacgcggcggccgccaacaacgtcaccaactggggcggcacctgctacatcaccccgctcatcggcgccttcctcgccgacgcctacctcggccgcttctggaccatcgcctccttcatgatcatctacatcttcggcctcggcctgctcaccatggccacctccgtgcacggcctcgtgcccgcctgcgcctccaagggcgtgtgcgaccccacgccgggccagtcggcggccgtcttcatcgcgctctacctcatcgcgctcggcaccggcgggatcaagccctgcgtctcctccttcggggccgaccagttcgacgagcacgacgacgtggagcgcaagagcaagagctccttcttcaactggttctacttctccatcaacatcggcgcgctggtggcctcgtccgtgctggtgtacgtgcagacgcatgtggggtggagctggggcttcggcatccccgccgtcgtcatggccatcgccgtcggcagcttcttcgtcggcacgccgctgtaccgccaccagcgccccggcggcagcccgctcacccgcatcgcgcaggtgctcgtggccgccacgcgcaagctcggcgtccccgtcgacgggtcggcgctgtacgagaccgcggacagggagtccggcatcgaggggagccgcaagctggagcacacggggcagttcaggttcctcgacaaggcggcggtggagacgcaggcggacaagacggcggccaccgggccgtcgccgtggcggctgtgcacggtgacgcaggtggaggagctcaagagcgtggtgcggctgctgcccatctgggcgagcggcatcgtcttcgccacggtgtacggccagatgagcaccatgttcgtgctacagggcaacaccctggacgcctccatgggtcccaagttcaagatcccctccgcctccctctccatcttcgacaccctcagcgtcatcgcctgggtgcccgtctacgaccgcatcctcgtcccggcagtgcgctccgtcaccggccggccccgcggcttcacccagctccagcgcatgggcatcggcctcgtggtctccatgttcgccatgctcaccgccggcgtgctcgagctcgtccgcctccgcaccatcgcgcagcgcggcctctacggggagaaggacgtggtgcccatctccatcttctggcaggtgccgcagtacttcatcatcggcgccgccgaggtgttcaccttcgtgggccagctcgagttcttctacgaccaggcgcccgacgccatgaggagcatgtgctccgcgctctcgctcaccaccgtcgcgctcgggaactacctcagcacgctgctcgtcaccgtcgtggccaagctcaccaccaggggaggcaagcaggggtggatccccgacaacctcaacgtcggccacctcgactacttcttctggctgctcgccgcgctcagcctcctcaacttcgccgtctacctcctcatcgccagctggtacacctacaagaagaccgccggagatgacccggacgccaaagccaaaggaggagctgatgatgcacatgaccagtgagtgactctggctgcaacagttcgtgtctgaatgcgtgcgtgttttctttttcaagagacatgacagaatagattgttgaaagaagaagaagaagaaagcaaggatcgagacttcagagttcagataggtgaaattaagggaggacaatgaaatgcgtggtgtgatttgtgacttcaagattcaagagtgttgccttgttgatt

SEQ ID NO: 314 - protein, 585 aa, Triticum aestivum
  misc_feature (1)..(585): Ceres Clone ID no. 816960
  misc_feature (1)..(585): Bit score of 933.0 for HMM based on sequences of Figure 6
  misc_feature (1)..(585): Functional Homolog Of SEQ ID NO. 209
  misc_feature (98)..(499): Pfam Name: PTR2 Pfam Description: POT family
MGEVAAELYTQDGTIDIKGNPALKSNTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTPLYRHQRPGGSPLTRIAQVLVAATRKLGVPVDGSALYETADRESGIEGSRKLEHTGQFRFLDKAAVETQADKTAATGPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLTAGVLELVRLRTIAQRGLYGEKDVVPISIFWQVPQYFIIGAAEVFTFVGQLEFFYDQAPDAMRSMCSALSLTTVALGNYLSTLLVTVVAKLTTRGGKQGWIPDNLNVGHLDYFFWLLAALSLLNFAVYLLIASWYTYKKTAGDDPDAKAKGGADDAHDQ

SEQ ID NO: 315 - protein, 570 aa, Arabidopsis thaliana
  misc_feature (1)..(570): Public GI ID no. 15232435
  misc_feature (1)..(570): Bit score of 906.6 for HMM based on sequences of Figure 6
  misc_feature (1)..(570): Functional Homolog Of SEQ ID NO. 209
  misc_feature (96)..(498): Pfam Name: PTR2 Pfam Description: POT family
MEEKDVYTQDGTVDIHKNPANKEKTGNWKACRFILGNECCERLAYYGMGTNLVNYLESRLNQGNATAANNVTNWSGTCYITPLIGAFIADAYLGRYWTIATFVFIYVSGMTLLTLSASVPGLKPGNCNADTCHPNSSQTAVFFVALYMIALGTGGIKPCVSSFGADQFDENDENEKIKKSSFFNWFYFSINVGALIAATVLVWIQMNVGWGWGFGVPTVAMVIAVCFFFFGSRFYRLQRPGGSPLTRIFQVIVAAFRKISVKVPEDKSLLFETADDESNIKGSRKLVHTDNLKFFDKAAVESQSDSIKDGEVNPWRLCSVTQVEELKSIITLLPVWATGIVFATVYSQMSTMFVLQGNTMDQHMGKNFEIPSASLSLFDTVSVLFWTPVYDQFIIPLARKFTRNERGFTQLQRMGIGLVVSIFAMITAGVLEVVRLDYVKTHNAYDQKQIHMSIFWQIPQYLLIGCAEVFTFIGQLEFFYDQAPDAMRSLCSALSLTTVALGNYLSTVLVTVVMKITKKNGKPGWIPDNLNRGHLDYFFYLLATLSFLNFLVYLWISKRYKYKKAVGRAH

SEQ ID NO: 316 - DNA, 1758 bp, Sorghum bicolor
  misc_feature (1)..(1758): Ceres Annot ID no. 8643789
  misc_feature (1)..(1758): Encodes the peptide sequence at SEQ ID NO. 317
atggcggccatggccagtggaggagatgagacgacgacgacgacgcttgacgggacgacggatcactccggcaagccggcggtgcggagcaagacggggacgtggcgcgcgtgccctttcatcctgggcaacgagtgctgcgagcgcctggcctactacggcatgagctccaacctcgtcaactacatgatcgaccgcctccaccaggggaacgccgccgccgccaacaacgtcagcaactggtccggcacctgctacgtcatgcccctcctcggcgccttcctggccgacgcctacctcggcaggtaccgcaccatcgccgccttcatggcgctctacatcctcggcctcacgctgctcaccatgagcgccgccgtcccgggcctcaggccgccgcccgacggagcaggcgccgtgaccgcgggccagagcgccgccttcttcgtggcgctctacctcatcgcggtgggcacgggaggcatcaagccctgcgtctcatccttcggcgccgaccagttcgacgacgccgacccgcgcgagcgccagagcaagagctccttcttcaactggttctacatgtccatcaacgtcggcgcactcctcgcctcctccgtgctcgtctgggtccagatgaacgtcggctggggatggggctttggcatccccgccgccgccatggccgtcgccgtcgccagcttcctgatggggagcaagctgtacaggcaccagaagccggggggcagcccgctcacgcggatgctgcaggtggtggtcgccgcctggaggaagggaaagcagcccgtgcccgcggacgcgtccctgctccacgaggcgtcctccgcctccgcgtccgccatccagggcagcaggaagctggagcacacggagcagttccggtggctggacagggcggcggtggtgacctccaccgatgaggacggcaagaacaaccccgacccctggcggctgtgcacggtgacgcaggtggaggagctcaagagtgtcatccgtcttctgccggtgtgggcgagcggcatcgtcatgtcggcggtgtacagccagatgagcaccatgttcgtgctgcagggcaacacgctggacccgcgcatgggctccggcgccggcgccttcaagatcccctccgcctcgctctccatcttcgacaccctcagcgtcatcgcctgggcgcccgcctacgaccgactcgtcgtccccgccgcgcgccgctggacggggcacccgcgcggcttcacgcagctccagcgcatgggcatcggcctcgccgtctccgtcctgtccatgctcgccgcgggggcgctggaggtggccaggctccgcgtcgccgcctcgcacggcatgctcgacgactccaccaactacctgcccatctccatcttctggcaggtgccgcagtacttcatcatcggagccgcagaggtgttcaccttcatcggccagatcgagttcttctacgaccaggcgccggacgccatgaggagcatgggcaccgcgctctcgctcacctcgtccgcgctcggcagctacctcagcgcgctgctggtgtccgtcgtcaccgccatcaccacgaggaacggcggcctcggctggatccccgacaacctcaaccggggccacctcgactacttcttctggctgctctccgtgctcagcgtcatcaacttcgtcgtctacctctggattgcaaagtggtacaggtacaagcaggcaaccacaagttatgaactcagcagtgtatag

SEQ ID NO: 317 - protein, 585 aa, Sorghum bicolor
  misc_feature (1)..(585): Ceres Annot ID no. 8643789
  misc_feature (1)..(585): Bit score of 865.5 for HMM based on sequences of Figure 6
  misc_feature (1)..(585): Functional Homolog Of SEQ ID NO. 209
  misc_feature (103)..(509): Pfam Name: PTR2 Pfam Description: POT family
MAAMASGGDETTTTTLDGTTDHSGKPAVRSKTGTWRACPFILGNECCERLAYYGMSSNLVNYMIDRLHQGNAAAANNVSNWSGTCYVMPLLGAFLADAYLGRYRTIAAFMALYILGLTLLTMSAAVPGLRPPPDGAGAVTAGQSAAFFVALYLIAVGTGGIKPCVSSFGADQFDDADPRERQSKSSFFNWFYMSINVGALLASSVLVWVQMNVGWGWGFGIPAAAMAVAVASFLMGSKLYRHQKPGGSPLTRMLQVVVAAWRKGKQPVPADASLLHEASSASASAIQGSRKLEHTEQFRWLDRAAVVTSTDEDGKNNPDPWRLCTVTQVEELKSVIRLLPVWASGIVMSAVYSQMSTMFVLQGNTLDPRMGSGAGAFKIPSASLSIFDTLSVIAWAPAYDRLVVPAARRWTGHPRGFTQLQRMGIGLAVSVLSMLAAGALEVARLRVAASHGMLDDSTNYLPISIFWQVPQYFIIGAAEVFTFIGQIEFFYDQAPDAMRSMGTALSLTSSALGSYLSALLVSVVTAITTRNGGLGWIPDNLNRGHLDYFFWLLSVLSVINFVVYLWIAKWYRYKQATTSYELSSV

SEQ ID NO: 318 - DNA, 1743 bp, Sorghum bicolor
  misc_feature (1)..(1743): Ceres Annot ID no. 8631367
  misc_feature (1)..(1743): Encodes the peptide sequence at SEQ ID NO. 319
atggatcctaccactattgattcgaaatggacgtctcccatcactgaagatgggtccatggacagacgaggaaacccagctgtcaagacaaccaccggaggatggagatctgccatcctgctgttagctaactatggactcgcgacgtgcgccttcttcggcgtcggcgtgaacctcgtggtgttcctgcgccgggtgctccaccagggcaacgccgaggcggccaacaacatcagcaagtggacagggaccgtctacatcttctccctcatcggcgccttcctcagcgactcctactggggccgttacgtcacctgcgccatctttcagatcatctatgtgacgggcctggtgatcctgtcgcttgcgtcatggttcttgttggtgaagccctccggctgcggcggcgtcaaggtgcactgcgacgagccgtcggcgcccggcgtcgcgctgttctacctgtccacctacatgatcgcgttcggcaacggagggtaccagccttccatcgcgaccttcggatcggaccagttcgacgagacggaccccaaggaggggcgctccaaggtcgccttcttcagctacttctacctggcgctcaacgtggggtccctgttttccaacacggtgctggtgtactacgaggactcagggcggtgggtcatggggttctgggtctcggcggccgccgccgcgctggcgctcgtgctcttcttgctcggcacgcccaactaccggcacttcaagccgagcggcaacccgctgacccgcgtcgcgcaggtgttcgtcgccgcgttccgcaagtggcacgctgaggttccccgcggcgagctcctccacgaggtggaaggagaggaccctaagatctcgggcatccgcaagatccttcacagcgacgagctcaggttcctcgacaaagcggcgacgatcaccgagggggagaagatggagaacccgtggaggctctgcacggtgacgcaggtggaggaggtgaagtgcatcctgaagatgctgcccatctggctgtgcacgatcgtgtactcggtggtgttcacccagatggcgtcgctgttcgtggagcagggcgccaccatggacaccaacatcgggtcgttccacttccccgcagcgagcatgtcgctgttcgacgtcctcagcgtgctggcgttcatcgccatctaccggcgggtcctggtgcccgtcatggcgcggctgtcgggcaacccgcagggcctgacggagctgcagcgcatgggcgtcgggctcgtgatcggcatggcggcgatggtggtggcgggcgtggtggaggtggagcggctgaagcgcgtggcagccccggaccagccgagctccctgagcgtgctgtggcaggtgccgcagtacgcgctgatcggggcgtcggaggtgttcatgtacgtggggcagctggagttcttcaacgggcaggcgcccgacggcgtcaagagcttcggcagcgcgctgtgcatggcgtccatctcgctggggaactacgtgagcatcatgctggtgagcgtggtcacaagcctcaccgccggggagaagcgtccggggtggatccctgggaacctcaactccggccacctggacaggttctacttcctcctcgcagcgctctcgctcgtcgacctcgccgtctacatcgcctgtgccatgtggtacaagggcatcaagcttgacggcggcgacggcgatgacagtagaaaggtctctgcgcatgtctag

SEQ ID NO: 319 - protein, 580 aa, Sorghum bicolor
  misc_feature (1)..(580): Ceres Annot ID no. 8631367
  misc_feature (1)..(580): Bit score of 1020.5 for HMM based on sequences of Figure 6
  misc_feature (1)..(580): Functional Homolog Of SEQ ID NO. 209
  misc_feature (103)..(498): Pfam Name: PTR2 Pfam Description: POT family
MDPTTIDSKWTSPITEDGSMDRRGNPAVKTTTGGWRSAILLLANYGLATCAFFGVGVNLVVFLRRVLHQGNAEAANNISKWTGTVYIFSLIGAFLSDSYWGRYVTCAIFQIIYVTGLVILSLASWFLLVKPSGCGGVKVHCDEPSAPGVALFYLSTYMIAFGNGGYQPSIATFGSDQFDETDPKEGRSKVAFFSYFYLALNVGSLFSNTVLVYYEDSGRWVMGFWVSAAAAALALVLFLLGTPNYRHFKPSGNPLTRVAQVFVAAFRKWHAEVPRGELLHEVEGEDPKISGIRKILHSDELRFLDKAATITEGEKMENPWRLCTVTQVEEVKCILKMLPIWLCTIVYSVVFTQMASLFVEQGATMDTNIGSFHFPAASMSLFDVLSVLAFIAIYRRVLVPVMARLSGNPQGLTELQRMGVGLVIGMAAMVVAGVVEVERLKRVAAPDQPSSLSVLWQVPQYALIGASEVFMYVGQLEFFNGQAPDGVKSFGSALCMASISLGNYVSIMLVSVVTSLTAGEKRPGWIPGNLNSGHLDRFYFLLAALSLVDLAVYIACAMWYKGIKLDGGDGDDSRKVSAHV

SEQ ID NO: 320 - protein, 612 aa, Vitis vinifera
  misc_feature (1)..(612): Public GI ID no. 157339093
  misc_feature (1)..(612): Bit score of 973.9 for HMM based on sequences of Figure 6
  misc_feature (1)..(612): Functional Homolog Of SEQ ID NO. 209
  misc_feature (141)..(544): Pfam Name: PTR2 Pfam Description: POT family
MLLFSVRIYVHFLSVREKNHEDLFSKQLGSLHYVSCVGWFILYLQNENSDLHTGDGSVDIHGKPVLRSNTGNWRACPFILGTECCERLAYYGIATNLVTYLTSKLHEGNVSAARNVTTWQGTCYLTPLIGAVLADAYCGRYWTIAAFSTIYFIGMCTLTLSATVPAFKPADCVGSVCPPATTAQYAVFFFGLYLIALGTGGIKPCVSSFGADQFDDTDPKERVKKGSFFNWFYFSINIGALVSSSFLVWIQDNAGWGLGFGIPALFMGIAIASFFSGTPLYRFQKPGGSPITRMCQVLVASFRKWKLEVPKDSNLLYETPDKNSAIEGSRKLEHSNELKCLDKAAVISDAEIKSGDFSNPWNLCTVTQVEELKILIRMFPIWATGIVFSAVYAQMSTMFVEQGMVMDTNIGSFTIPPASLSTFDVISVIFWVPVYDRILVPIARKFTGKERGFSELQRMGIGLFLSVLCMSAAALVEIKRLQLATALDLVDEDVAVPLSILWQIPQYFLLGAAEVFTFIGQLEFFYDQSPDAMRSLCSALSLLTTSLGNYLSAFILTVVTTLTTEDGKTGWIPDNLNKGHLDYYFWLLAGLSFLNLLVYMICAKIYKRKKGS

SEQ ID NO: 321 - DNA, 1767 bp, Sorghum bicolor
  misc_feature (1)..(1767): Ceres Annot ID no. 8633031
  misc_feature (1)..(1767): Encodes the peptide sequence at SEQ ID NO. 322
atggccggcgccgagcgcgtggaggctccctccttggaggagcaagggctcctcgctctagaggaatccaaccaactagtatacactggagatggatcagttgacttttctggaaatcctgttatcaaggaaagaactggtagatggaaggcatgtccattcatattaggtaatgaatgctgtgaacgactggcctattatggcatcgccacgaaccttgttacttacttgacaaaaaagctacatgttggcaatgcctctgctgctagcaacgtgactacatggcagggaacttgctacttgactccgcttattggagcagtcctggctgatgcatactgggggaagtattggataattgcaacatcctccatagtgtacttcatcgggatggtaatactgactctttcagcatcagttcctatgctcatgcctccatcctgtgaaggatccttttgcgcaccagcaagcccttttcagtatactgtcttttttcttggtctttatctgattgcactgggtgctggtggaattaagccatgcgtctcgtcctttggagctgatcaatttgatgatacagatcctgatgagcgaatccagaagggttctttctttaattggttctatctttcaataaatattggtggcctcatatcaagcagctttctggtttgggtgcaagacaatgttggatggggactgggctttggcattccgacagtatccatggggctggcaatcataagcttcttctctggcacatcactttataggttccaaaaacctggaggtagtcctattacacgagtatgccaggtgattgttgcctcgttgcgcaagtggaatgtgcatgtcccagaggacagctctctcttgtatgagcaacctgatggggtatcaacaattgaggggagtcggcaattagagcacacagatgaactcagattttttgacaaggctgctacagttgccaaagttgacgtgaaaactgctgacttcaacaatccatggcggatatgcacagtcacgcaggtggaagaactaaagatactggtaaggatgttccctatatgggcaacaacaatcgtgttttctgttgcatatgctcagatgtcaacaatgtttgtggaacaaggcatggtgcttgacccatccttgggttcattcaagtttcctccagcgtcgttatctacttttgacaccctaaccatcatcatatgtgtcccgatgtacaattacatcatggttccaatagctaggagattcactggcaacgggaggggctttacagagttgcagaggatgggcattggcctggtaatttccatcatagctatgtcagtcgctgcaatccttgaaatcaagcggctagaagttgccagggaagcacacctggtagatcagaacatcccagtcccattgagcatattctggcaaatccctcagtatttcctgatcggtctagcggaggtgttcacattcatcggagcgctcgagttcttttataatcagtcaccggatgccatgaggagcgtctgcagcgcacttaatcttctcaccgtttcctttgggaactatctcaacacgttcattttgacaatggttgcatactttactacaaggggaggtaaccctggatggattcctgacaacttgaacgaagggcatcttgattacttcttctggctcattgctggcctcagttttctgaacctgattgtatatgtcatctgtgctagcaaatacaagagcaagaaggcagcttga

SEQ ID NO: 322 - protein, 588 aa, Sorghum bicolor
  misc_feature (1)..(588): Ceres Annot ID no. 8633031
  misc_feature (1)..(588): Bit score of 920.4 for HMM based on sequences of Figure 6
  misc_feature (1)..(588): Functional Homolog Of SEQ ID NO. 209
  misc_feature (117)..(520): Pfam Name: PTR2 Pfam Description: POT family
MAGAERVEAPSLEEQGLLALEESNQLVYTGDGSVDFSGNPVIKERTGRWKACPFILGNECCERLAYYGIATNLVTYLTKKLHVGNASAASNVTTWQGTCYLTPLIGAVLADAYWGKYWIIATSSIVYFIGMVILTLSASVPMLMPPSCEGSFCAPASPFQYTVFFLGLYLIALGAGGIKPCVSSFGADQFDDTDPDERIQKGSFFNWFYLSINIGGLISSSFLVWVQDNVGWGLGFGIPTVSMGLAIISFFSGTSLYRFQKPGGSPITRVCQVIVASLRKWNVHVPEDSSLLYEQPDGVSTIEGSRQLEHTDELRFFDKAATVAKVDVKTADFNNPWRICTVTQVEELKILVRMFPIWATTIVFSVAYAQMSTMFVEQGMVLDPSLGSFKFPPASLSTFDTLTIIICVPMYNYIMVPIARRFTGNGRGFTELQRMGIGLVISIIAMSVAAILEIKRLEVAREAHLVDQNIPVPLSIFWQIPQYFLIGLAEVFTFIGALEFFYNQSPDAMRSVCSALNLLTVSFGNYLNTFILTMVAYFTTRGGNPGWIPDNLNEGHLDYFFWLIAGLSFLNLIVYVICASKYKSKKAA

SEQ ID NO: 323 - protein, 591 aa, Oryza sativa
  misc_feature (1)..(591): Public GI ID no. 125543029
  misc_feature (1)..(591): Oryza sativa Indica Group
  misc_feature (1)..(591): Bit score of 893.3 for HMM based on sequences of Figure 6
  misc_feature (1)..(591): Functional Homolog Of SEQ ID NO. 209
  misc_feature (121)..(523): Pfam Name: PTR2 Pfam Description: POT family
MEEAAEDRRLQVREEGGDQEPLLLLPQDANLYTGDGSVDIKGRPALKHATGNWRACFFILGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNAVYAQNSSMFIEQGMVLDKRVGSFIVPPASLSTFDVISVIIWIPFYDRVLVPIARKFTGREKGFSELQRIGIGLALSILAMLSAALVELRRLEIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 324 - protein, 593 aa, Oryza sativa
  misc_feature (1)..(593): Public GI ID no. 115454995
  misc_feature (1)..(593): Oryza sativa Indica Group
  misc_feature (1)..(593): Bit score of 951.7 for HMM based on sequences of Figure 6
  misc_feature (1)..(593): Functional Homolog Of SEQ ID NO. 209
  misc_feature (122)..(525): Pfam Name: PTR2 Pfam Description: POT family
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 325 - DNA, 1758 bp, Medicago truncatula
  misc_feature (1)..(1758): Ceres Annot ID no. 8755090
  misc_feature (1)..(1758): Encodes the peptide sequence at SEQ ID NO. 326
atggaaccagcaggaccccccaacaatgtcaatcctgacaatattgaagtagttgaggcgacagaaggaaatcatgtcaatggagaagtggcagatggaaagagtaaaggaggatggacaactgcatacatcttgctagctaatcaagcactggcaacactagcattctttggagttggagtgaacttggttctgttcctaacgagagtccttcgtcaagacagtgccgaggctgctaataatgtcagcttgtggactggaactgtttacatattttcactcttgggagcattccttagtgattcttattggggaagatacttaacatgcgctatctttcagctcttctttgttctgggtttggggctgatgtctttgacatcatggctgtttttgatcaaaccattaggttgcggtaatgaacatagcgtttgcaatgaaccaacaccattgggaataggcctattctatttgtcaatatatttggttgcatttggatatggagggcatcaacctaccttagcaacatttggagctgatcaatttgatgataagagtattcaacaaaccaactccagagaggctttctttagttacttttactttgcactcaatgttggatcactattttccaacaccattttggtttattacgaagataccggtatgtggacattgggtttcggtgtctccttagcctctgctattatagccttgatttcattcttagcaggatctcgaaaatatcgatatgttaaggcgtatggcaatcctgtcataagagtaatccaggtctttgttgctgccactaggaagtggaatgttgaacccgccaaggaggaccaactttacgaggttgacggcaatgtatccgccatcaaaggaagcagaaagattcttcactcccaagatataagattcatggacaaggcggcaacacggacagtaaaagacgggaatgaatccgggaaccaatggcgactttgcactgtaactcaagttgaggaagccaaatgtgtgttgagaatgataccagtttggctgtgcactattatttactctgttgtattcacacaaatggcttctctttttgtcgaacaaggtgatgtaatgaacaacaaggtaggaaaatttcacttgccagcagcaaccatgtctgtgtttgatatatgcagtgtccttgtatgcactggactttatcgccaagttctagttcccttggccggaaaattaagcggtaatcctaaggggttaagcgaacttcaaagaatgggagttggcctagttattggaatgcttgcgatggttgcagctggtgtaacggagtttgaaaggcttaaacaagttcagcctggacagaaacaaagtaatttgagtatattctgtcaaattccacagtatgttcttgttggtgcttcagaagtttttatgtatgtgggtcagttggagttcttcaatggtcaagcacctgatggcataaaaagctttggaagttcactttgtatggcatcaatttctcttggaaactatgttagcagcatgatggtgaaattggtgatgatattcactgctagaggcgaggaacctggatggattccgaataacttaaatgttgggcacatggacaggtttttctacctcattgcagcgctaagtgcccttgaccttgtcatctatgtgttctgtgctcggtggtacaagggtgtcacgaacattgaaggtagtgacaatgtcggaagccaagaggacaatgtttga

SEQ ID NO: 326 - protein, 585 aa, Medicago truncatula
  misc_feature (1)..(585): Ceres Annot ID no. 8755090
  misc_feature (1)..(585): Bit score of 907.2 for HMM based on sequences of Figure 6
  misc_feature (1)..(585): Functional Homolog Of SEQ ID NO. 209
  misc_feature (109)..(504): Pfam Name: PTR2 Pfam Description: POT family
MEPAGPPNNVNPDNIEVVEATEGNHVNGEVADGKSKGGWTTAYILLANQALATLAFFGVGVNLVLFLTRVLRQDSAEAANNVSLWTGTVYIFSLLGAFLSDSYWGRYLTCAIFQLFFVLGLGLMSLTSWLFLIKPLGCGNEHSVCNEPTPLGIGLFYLSIYLVAFGYGGHQPTLATFGADQFDDKSIQQTNSREAFFSYFYFALNVGSLFSNTILVYYEDTGMWTLGFGVSLASAIIALISFLAGSRKYRYVKAYGNPVIRVIQVFVAATRKWNVEPAKEDQLYEVDGNVSAIKGSRKILHSQDIRFMDKAATRTVKDGNESGNQWRLCTVTQVEEAKCVLRMIPVWLCTIIYSVVFTQMASLFVEQGDVMNNKVGKFHLPAATMSVFDICSVLVCTGLYRQVLVPLAGKLSGNPKGLSELQRMGVGLVIGMLAMVAAGVTEFERLKQVQPGQKQSNLSIFCQIPQYVLVGASEVFMYVGQLEFFNGQAPDGIKSFGSSLCMASISLGNYVSSMMVKLVMIFTARGEEPGWIPNNLNVGHMDRFFYLIAALSALDLVIYVFCARWYKGVTNIEGSDNVGSQEDNV

SEQ ID NO: 327 - DNA, 1794 bp, Glycine max
  misc_feature (1)..(1794): Ceres Annot ID no. 8755097
  misc_feature (1)..(1794): Encodes the peptide sequence at SEQ ID NO. 328
atggcctgcttagaagtcagcaaagaggtaaagttcaaaggtgacacggaagaactcactcttgatggaagtgttgattggcatggtcgccctgcaattagagccaaatctggcagatgggttgctggaaccatcgttctattgaaccaaggtctggcaaccttagcattctttggagtaggggtgaacctagtgctgttcctgacaagagtgatggggcaagataatgctgaagctgcaaacaatgtgagcaagtggactggcacagtttacatcttctctcttgtgggtgctttcctaagtgattcgtattggggaagatacaaaacttgtgccatctttcaggtcatctttgtaataggtctagtatccttgtctctttcatcatacctctccttgattaggcctaaaggttgtgggaatgaaacaattccatgtgggaaacattcaagcttggagatggggatgttctacctctcaatctatcttattgctttagggaatggagggtatcaaccaaatattgccacatttggagctgatcagtttgacgaggagcactcaaaggagggttactcaaaggttgccttctttagctacttctatctggctttgaaccttggttcactcttctcaaacacaattctaggctattttgaagatgaaggactgtgggctctagggttctgggtgtctgcaggctctgcttttgctgcccttgtcttatttcttcttgggaccccaagatatagacacttcaaacctagtggcaatcctctttcaaggttcagccaagtccttgttgctgcatcaaggaaatggagagctcaaatggcatcaaatggagaggatctatatgtcatggatgaaaatgaatctcccaccaatggcaacaggaagattctccacaccgaagggttcaagtttctggatagagcagcgattatatcttccagagatctagaagaccaaaagagtggcgtttataacccctggcgtctctgccctataactcaagttgaagaagtgaagtgcatactaagacttcttcctatttggctttgcacgataatatactcagtggttttcacacaaatggcttctctttttgtggagcaaggggctgccatgaaaactacaatttcccatttcagaataccacctgcaagcatgtctagctttgacatcctcagcgtagctgtcttcattttcttctaccgtcgagtgattgatccacttgtcggaagacttaaaaagaaaagttccaagggacttactgagcttcagagaatgggaatagggcttgttatagctgtaatggcaatggtttcagctggaatagttgaatgctacagacttaagtatgcagacccagtatgcccccactgcagtggcacaagctctttaaccatcttttggcaaattcctcagtacacacttattggagcttcagaggttttcatgtatgtaggccagttagagttcttcaatgctcagacgccagatggcttaaagagcttcggaagtgccctttgcatgacgtccatatctcttgggaactacgtaagtagcttacttgttagtatagttatgaagatctccactgaggatcacatgccagggtggatccctggaaacttaaacagaggtcacctagataggttttacttcctcttagctatcttgacatctatagatttggtcctttatattgcatgtgcaaagtggttcaagagtatacagctggaagggaaatatgaagagaatgatatgcctggtagctttaaagtctaa

SEQ ID NO: 328 - protein, 597 aa, Glycine max
  misc_feature (1)..(597): Ceres Annot ID no. 8755097
  misc_feature (1)..(597): Bit score of 997.0 for HMM based on sequences of Figure 6
  misc_feature (1)..(597): Functional Homolog Of SEQ ID NO. 209
  misc_feature (108)..(515): Pfam Name: PTR2 Pfam Description: POT family
MACLEVSKEVKFKGDTEELTLDGSVDWHGRPAIRAKSGRWVAGTIVLLNQGLATLAFFGVGVNLVLFLTRVMGQDNAEAANNVSKWTGTVYIFSLVGAFLSDSYWGRYKTCAIFQVIFVIGLVSLSLSSYLSLIRPKGCGNETIPCGKHSSLEMGMFYLSIYLIALGNGGYQPNIATFGADQFDEEHSKEGYSKVAFFSYFYLALNLGSLFSNTILGYFEDEGLWALGFWVSAGSAFAALVLFLLGTPRYRHFKPSGNPLSRFSQVLVAASRKWRAQMASNGEDLYVMDENESPTNGNRKILHTEGFKFLDRAAIISSRDLEDQKSGVYNPWRLCPITQVEEVKCILRLLPIWLCTIIYSVVFTQMASLFVEQGAAMKTTISHFRIPPASMSSFDILSVAVFIFFYRRVIDPLVGRLKKKSSKGLTELQRMGIGLVIAVMAMVSAGIVECYRLKYADPVCPHCSGTSSLTIFWQIPQYTLIGASEVFMYVGQLEFFNAQTPDGLKSFGSALCMTSISLGNYVSSLLVSIVMKISTEDHMPGWIPGNLNRGHLDRFYFLLAILTSIDLVLYIACAKWFKSIQLEGKYEENDMPGSFKV

SEQ ID NO: 329 - DNA, 1797 bp, Glycine max
  misc_feature (1)..(1797): Ceres Annot ID no. 8755098
  misc_feature (1)..(1797): Encodes the peptide sequence at SEQ ID NO. 330
atgtcttgcttagagtctcatgtctacaaagaggtaattagaaagtttgaagaagagtcagaagaagtcactcttgatgggagtgttgatttccatggacgtcctgcaatcagagccaaatctggcagatgggtggctgcaattatcatactcttgaaccaagctctggcaacccttgcattctttgggatcggcgtgaacctagtgttgtttctgacaagggtggtaggacaaaacaatgctgatgcagccaacaatgtgagcaagtggaccggaactgtttacatcttctctcttgtgggtgctttcctcagtgattcttattggggaagatataaaacatgtgctgtctttcaggtcatctttgttataggtctaatgtccttatccctgtcatcatacctattcttgcttaagcctaaaggttgtgggaatgaaacagttagttgtgggaaacattcaaaattggagatggggatgttctacctctcaatctatcttgttgccttggggaatggaggttatcaaccaaatattgccacatttggggctgatcagtttgatgaggagcactcaaaggagggtcacaacaaggtggccttctttagctacttctacctagcttttaacattggccaactcttctcaaacaccattcttgtctattttgaggacgaaggaatgtgggctcttggtttctggctgtctgcaggatctgcctttgctgcattggtcttgtttcttatatgcaccccaaggtatagacacttcaagcccagtggcaaccctatctccaggttcagccaagtcctagtggctgcatcaaggaaatccaaacttcaaatgtcatcaaacggagaggacttattcaacatggatgcaaaggaggcatccaacgatgccaacagaaagattctccacactcacgggttcaagttcttggatagggcagcgttcatatcttcaagagatctaggggaccagaaagggctcggttacaacccatggcgtctctgtcctgtaagtcaagttgaagaagtgaagtgcatactgagacttcttccaatctggctctgcaccataatatactcagtagttttcacacaaatggcttcactttttgtggagcaaggtgctgccatgaaaaccaaggtttccaacttcagaataccaccagctagcatgtccagctttgatatcctcagtgtggctgttttcattttcttttaccgtcgagttcttgatccatttgtgggaaaacttaaaaagacagattctaagggacttacagagcttcagagaatgggagttggacttgttatagctgtactggcaatggtttcggctggattagttgaatgctataggctcaagtatgcaaaacaaggatgcctacactgcaatgactcgagcactttaagcatcttctggcaaatccctcagtatgcatttataggagcttctgaggtttttatgtacgtaggtcagttggagttcttcaacgctcagacaccagacggcttaaagagctttggaagtgctctttgcatgacatccatttcccttgggaactatgtgagtagtttacttgttagtgtggttatgaagatatccaccgaagatcacatgccggggtggatccctggacacctcaacaaaggccacttagataggttttacttcctcttagctgccttgacatcgatagacttgatcgcttatattgcatgtgcaaaatggtacaagtctatacagctagaggccaaaactggagagattgatgagacacaagtataa

SEQ ID NO: 330 - protein, 598 aa, Glycine max
  misc_feature (1)..(598): Ceres Annot ID no. 8755098
  misc_feature (1)..(598): Bit score of 976.8 for HMM based on sequences of Figure 6
  misc_feature (1)..(598): Functional Homolog Of SEQ ID NO. 209
  misc_feature (112)..(519): Pfam Name: PTR2 Pfam Description: POT family
MSCLESHVYKEVIRKFEEESEEVTLDGSVDFHGRPAIRAKSGRWVAAIIILLNQALATLAFFGIGVNLVLFLTRVVGQNNADAANNVSKWTGTVYIFSLVGAFLSDSYWGRYKTCAVFQVIFVIGLMSLSLSSYLFLLKPKGCGNETVSCGKHSKLEMGMFYLSIYLVALGNGGYQPNIATFGADQFDEEHSKEGHNKVAFFSYFYLAFNIGQLFSNTILVYFEDEGMWALGFWLSAGSAFAALVLFLICTPRYRHFKPSGNPISRFSQVLVAASRKSKLQMSSNGEDLFNMDAKEASNDANRKILHTHGFKFLDRAAFISSRDLGDQKGLGYNPWRLCPVSQVEEVKCILRLLPIWLCTIIYSVVFTQMASLFVEQGAAMKTKVSNFRIPPASMSSFDILSVAVFIFFYRRVLDPFVGKLKKTDSKGLTELQRMGVGLVIAVLAMVSAGLVECYRLKYAKQGCLHCNDSSTLSIFWQIPQYAFIGASEVFMYVGQLEFFNAQTPDGLKSFGSALCMTSISLGNYVSSLLVSVVMKISTEDHMPGWIPGHLNKGHLDRFYFLLAALTSIDLIAYIACAKWYKSIQLEAKTGEIDETQV

SEQ ID NO: 331 - DNA, 1761 bp, Glycine max
  misc_feature (1)..(1761): Ceres Annot ID no. 8755099
  misc_feature (1)..(1761): Encodes the peptide sequence at SEQ ID NO. 332
atggaagaaaaggtaaataaggagcaccaggtttgcacatcggatggagctattgatagccagggtcatcctgcagttcgagagaaaacgggtgactgggttgctgcaattttgattttagtgaatcaagggcttgctactttggcattctttggaattggagtgaatttggtgttgtttttgacgagagtgatgggtcaagacaatgctgaagcagccaacagtgtgagcaagtggacagggacagtttacctcttctctcttcttggagccttccttagtgactcttactggggaaggtacatgacctgtgccatcttccaggtcatatttgttattggtttggtgtcattatcactatcgtcttacatattcctactgaagccaagtggttgtggaaataaagagttaccatgtggatcacactcatcataccaaacgattttattctatgtttccatatacctaatagctctaggaaatggaggataccagcctaacattgctacatttggggctgatcaatttgatgaaggagataccagggaacaacattcaaaaattgtatttttcagctatttttatttggctttgaacattgggtcactcttctccaacaccatattgaattattttgaggatgatggactatggactttggggttctgggcttcagctggctctgctgctctggcattggttttgtttctttgtggcacacgaaggtatagatactttaagcctaatggaaaccctcttcctagattttgccaagtttttgtggctgctacaagaaaatggaaggtcaaggtgttacaagatgataaactttacgaggttgatgaattctcaaccgatgaagggagaaaaatgctccatactgaaggatttagattcttagacaaagcagcatttatcacatcaaagaatttcaaacaaatggaagagagtaaatgcagtccatggtatctatccactgtgacacaagtagaagaagtgaaatgcattctaagactactcccaatttggctatgcaccatattatactctgtcgtttttgctcaaatggcatcactttttgtggagcaaggcgatgccatggacactagaatatcatctttccacattcctccagcaagcatgtccacctttgacattctaagtgtagcaattgtcatcttcatttataggcgagttctcgaccctcttgtggccagaacaatgaaatcaaaaggactcactgaacttcaaaggatgggaattggtctagtcctagcaattatggccatggtttcagcaggattggtggagcactttaggctaaagaatgcaatagaagactgcaatgaatgtaaagggtctagttcactttccatattttggcaagtgccacaatatgtgtttgtgggggcatcagaagttttcatgtatgtgggtcaattagagttcttcaatgcacaaacacctgatggattaaagagttttggtagtgcactttgcatgacttcaatatcacttggaaactacgttagtagcttgcttgttgcaattgtgatgaagatttctgccacagatgagatgccaggatggatcccaggaaacttgaacaaagggcatttggatatgttttacttcctcttagcagcactcaccgcagctgatcttgtaatatatgtactgatggctaggtggtataaatatgtcaaatttcaaggaaacaatgagaatgacaccaacaaagaagaccctgaagtagtgtag

SEQ ID NO: 332 - protein, 586 aa, Glycine max
  misc_feature (1)..(586): Ceres Annot ID no. 8755099
  misc_feature (1)..(586): Bit score of 999.0 for HMM based on sequences of Figure 6
  misc_feature (1)..(586): Functional Homolog Of SEQ ID NO. 209
  misc_feature (101)..(503): Pfam Name: PTR2 Pfam Description: POT family
MEEKVNKEHQVCTSDGAIDSQGHPAVREKTGDWVAAILILVNQGLATLAFFGIGVNLVLFLTRVMGQDNAEAANSVSKWTGTVYLFSLLGAFLSDSYWGRYMTCAIFQVIFVIGLVSLSLSSYIFLLKPSGCGNKELPCGSHSSYQTILFYVSIYLIALGNGGYQPNIATFGADQFDEGDTREQHSKIVFFSYFYLALNIGSLFSNTILNYFEDDGLWTLGFWASAGSAALALVLFLCGTRRYRYFKPNGNPLPRFCQVFVAATRKWKVKVLQDDKLYEVDEFSTDEGRKMLHTEGFRFLDKAAFITSKNFKQMEESKCSPWYLSTVTQVEEVKCILRLLPIWLCTILYSVVFAQMASLFVEQGDAMDTRISSFHIPPASMSTFDILSVAIVIFIYRRVLDPLVARTMKSKGLTELQRMGIGLVLAIMAMVSAGLVEHFRLKNAIEDCNECKGSSSLSIFWQVPQYVFVGASEVFMYVGQLEFFNAQTPDGLKSFGSALCMTSISLGNYVSSLLVAIVMKISATDEMPGWIPGNLNKGHLDMFYFLLAALTAADLVIYVLMARWYKYVKFQGNNENDTNKEDPEVV

SEQ ID NO: 333 - protein, 584 aa, Artificial sequence
  abiotic stress tolerance-increasing polypeptide
  misc_feature (1)..(584): Bit score of 1001.9 for HMM based on sequences of Figure 6
  misc_feature (1)..(584): Functional Homolog Of SEQ ID NO. 209
  misc_feature (101)..(503): Pfam Name: PTR2 Pfam Description: POT family
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLVMLSLSTGALLLEPSGCGVEESPCKPHSTVKTVIFYLSVYLIALGYGGYQPNIATFGADQFDADDSVEGHSKIAFFSYFYLALNLGSLLSNTVLGYFEDQGAWPLGFWASAGSAFAGLVLFLTGTPKYRHFKPRESPWSRFCQVLVASTRKAKIDVNYEDMNLYDSETQRTGDKKILHTKGFRFLDRAAIVTPDDEAEKVESGSTYDPWRLCSVTQVEEVKCVLRLLPIWLCTILYSVVFTQMASLFVVQGAAMKTNIKDFRIPASSMSTFDILSVAFFIFAYRRFLDPLFARLNKREPNKGLTELQRMGIGLVIAITAMISAGIVEIYRLKHKETASNSSSLSIFWQVPQYMMIGASEVFMYVGQLEFFNSQAPTGLKSFASALCMASISLGNYVSSLLVSIVMKISTRDYLPGWIPGNLNKGHLDRFYFLLAGLTAADFLVYLVCAKWYKYIKSEASFSESMDEEEEV

SEQ ID NO: 334 - protein, 596 aa, Glycine max
  misc_feature (1)..(596): Bit score of 979.8 for HMM based on sequences of Figure 6
  misc_feature (1)..(596): Functional Homolog Of SEQ ID NO. 209
  misc_feature (110)..(517): Pfam Name: PTR2 Pfam Description: POT family
MSYLESQVYKERKFEEESEEVTLDGSVDFHGRPAIRAKSGRWVAAIIILLNQALATLAFFGIGVNLVLFLTRVVGQNNADAANNVSKWTGTVYIFSLVGAFLSDSYWGRYKTCAVFQVIFVIGLMSLSLSSYLFLLKPKGCGNESVNCGKHSKLEMGMFYLSIYLVALGNGGYQPNIATFGADQFDEEHSKEGHNKVAFFSYFYLAFNIGQLFSNTILVYFEDEGMWALGFWLSAGSAFAALVLFLVCTPRYRHFKPSGNPLSRFSQVLVAASRKSKVQMSSNGEDLFNMDAKEASNNANRKILHTHGFKFLDRAAFISSRDLGDQKGLGYNPWHLCPVSQVEEVKCILRLLPIWLCTIIYSVVFTQMASLFVEQGAAMKTKVSNFRIPPASMSSFDILSVAVFIFFYRRVLDPFVGKLKKTDSKGLTELQRMGVGLVIAVLAMVSAGLVECYRLKYAKQGCIHCNDSSTLSIFWQIPQYAFIGASEVFMYVGQLEFFNAQTPDGLKSFGSALCMTSISLGNYVSSLLVSVVMKISTEDHMPGWIPGNLNKGHLDRFYFLLAALTSIDLIAYIACAKWYKSIQLEANTGEIDEPEV

SEQ ID NO: 335 - protein, 526 aa, Arabidopsis thaliana
  misc_feature (1)..(526): Bit score of 903.6 for HMM based on sequences of Figure 6
  misc_feature (1)..(526): Functional Homolog Of SEQ ID NO. 209
  misc_feature (38)..(445): Pfam Name: PTR2 Pfam Description: POT family
MGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 336 - DNA, 1800 bp, Arabidopsis thaliana
  misc_feature (1)..(2310): Ceres Annot ID no. 872104m
  misc_feature (1)..(2310): Encodes the peptide sequence at SEQ ID NO. 337
atggcttctttcacggcaacggctgcggtttctgggagatggcttggtggcgatcatactcagccgccattatcgtcttctcaaagctccgacttgagttattgtagctccttacctatggccggtcgtgtcacacgtaagctcaatgtttcatctgcgcttcacactcctccagctcttcatttccctaagcaatcatcaaactctcccgccattgttgttaagcccaaagccaaagaatccaacaataaacagatgaatttgttccagagagcggcggcggcagcgttggacgcggcggagggtttccttgtcagccacgagaagctacacccgcttcctaaaacggctgatcctagtgttcagatcgccggaaattttgctccggtgaatgaacagcccgtccggcgtaatcttccggtggtcggaaaaattcccgattccatcaaaggagtgtatgtgcgcaacggagctaacccacttcacgagccggtgacaggtcaccacttcttcgacggagacggtatggttcacgccgtcaaattcgaagacggttcagctagctacgcttgccggttcactcagactaaccggtttgttcaggaacgtcaattgggtcgaccggttttccccaaagccatcggtgagcttcacggacacaccggtattgcccggctcatgctattctacgccagagctgcagccggtatagtcggcccggcacacggaaccggtgtggccaacgccggtttggtctatttcaacggccggttattggctatgtcggaggatgatttaccttaccaagttcggatcactcccaatggagatttaaaaaccgttggtcggttcaattttgatggacaattagaatccacaatgattgcccacccgaaagtcgacccggaatccggtgaactcttcgctttaagctacgacgtcgtttcaaagccttacctaaaatacttccgattctcaccggacggaactaaatcaccggacgtcgagattcagcttgatcagccaacgatgatgcacgatttcgcgattacagagaacttcgtcgtcgtacctgaccagcaagtcgttttcaagctgccggagatgatccgcggtgggtctccggtggtttacgacaagaacaaggtcgcaagattcgggattttagacaaatacgccgaagattcatcgaacattaagtggattgatgctccagattgcttctgcttccatctctggaacgcttgggaagagccagaaacagatgaagtcgtcgtgatagggtcctgtatgactccaccagactcaattttcaacgagtctgacgagaatctcaagggtgtcctgtctgaaatccgcctgaatctcaaaaccggtgaatcaactcgccgtccgatcatctccaacgaagatcaacaagtcaacctcgaagcagggatggtcaacagaaacgtgcttggccgtaaaaccaaattcgcttacttggctttagccgagccgtggcctaaagtctcaggattcgctaaagttgatctcactactggagaagttaagaaacatctttacggcgataaccgttacggaggagagcctctgtttctccccggagaaggaggagaggaagacgaaggatacatcctctgtttcgttcacgacgagaagacatggaaatcggagttacagatagttaacgccgttagcttagaggttgaagcaacggttaaacttccgtcaagggttccgtacggatttcacggtacattcatcggagccgatgatttggcgaagcaggtcgtgtga

SEQ ID NO: 337 - protein, 599 aa, Arabidopsis thaliana
  misc_feature (1)..(599): Ceres Annot ID no. 872104m
  misc_feature (1)..(599): Bit score of 1162.1 for HMM based on sequences of Figure 2
  misc_feature (1)..(599): in Figure 2
  misc_feature (124)..(589): Pfam Name: RPE65 Pfam Description: Retinal pigment epithelial membrane protein
MASFTATAAVSGRWLGGDHTQPPLSSSQSSDLSYCSSLPMAGRVTRKLNVSSALHTPPALHFPKQSSNSPAIVVKPKAKESNNKQMNLFQRAAAAALDAAEGFLVSHEKLHPLPKTADPSVQIAGNFAPVNEQPVRRNLPVVGKIPDSIKGVYVRNGANPLHEPVTGHHFFDGDGMVHAVKFEDGSASYACRFTQTNRFVQERQLGRPVFPKAIGELHGHTGIARLMLFYARAAAGIVGPAHGTGVANAGLVYFNGRLLAMSEDDLPYQVRITPNGDLKTVGRFNFDGQLESTMIAHPKVDPESGELFALSYDVVSKPYLKYFRFSPDGTKSPDVEIQLDQPTMMHDFAITENFVVVPDQQVVFKLPEMIRGGSPVVYDKNKVARFGILDKYAEDSSNIKWIDAPDCFCFHLWNAWEEPETDEVVVIGSCMTPPDSIFNESDENLKGVLSEIRLNLKTGESTRRPIISNEDQQVNLEAGMVNRNVLGRKTKFAYLALAEPWPKVSGFAKVDLTTGEVKKHLYGDNRYGGEPLFLPGEGGEEDEGYILCFVHDEKTWKSELQIVNAVSLEVEATVKLPSRVPYGFHGTFIGADDLAKQVV

SEQ ID NO: 338 - protein, 592 aa, Hordeum vulgare
  misc_feature (1)..(592): Public GI ID no. 112181147
  misc_feature (1)..(592): Hordeum vulgare subsp. vulgare
  misc_feature (1)..(592): Bit score of 1175.0 for HMM based on sequences of Figure 2
  misc_feature (1)..(592): Functional Homolog Of SEQ ID NO. 337
  misc_feature (1)..(592): in Figure 2
  misc_feature (115)..(584): Pfam Name: RPE65 Pfam Description: Retinal pigment epithelial membrane protein
MQTLTASSSVSSIQRHRPHPAGRRSSSVTFSARAVSSAPRAPAPSRFVRGADAAPAKPLIAVPKPPAVERQEKKLNFFQRAAATALDAFEEGFVANVLERPHGLSRTVDPAVQIAGNFAPVGETPPVQALPVTGRIPPFINGVYARNGANPHFDPVAGHHLFDGDGMVHALRIRNGVAETYASRFTETERLQQERALGRPMFPKAIGELHGHSGIARLALFYARAACGLIDPSRGTGVANAGLVYFNGHLLAMSEDDIPYHVRVTDDGDLQTVGRYDFDGQLECPMIAHPKLDPATGELHALSYDVIKKPYLKYFYFAADGTKSADVEIPLDQPTMIHDFAITENYVVVPDHQVVFKLQEMLRGGSPVVLDKEKTSRFGVLPKCAADASEMVWVDVPDCFCFHLWNAWEEEETDEVVVIGSCMTPADSIFNESDECLESVLTEIRLNTRTGESTRRPILALSEQVNLEVGMVNSNLLGRKTRYAYLAVAEPWPKVSGFAKVDLATGELTKFEYGEGRFGGEPCFVPMDPATSRGEDDGYILTFVHDEAAGTSELLVVNAADMRLEATIQLPSRVPYGFHGTFITGKELESQA

SEQ ID NO: 339 - protein, 599 aa, Arabidopsis thaliana
  misc_feature (1)..(599): Public GI ID no. 15810433
  misc_feature (1)..(599): Bit score of 1160.0 for HMM based on sequences of Figure 2
  misc_feature (1)..(599): Functional Homolog Of SEQ ID NO. 337
  misc_feature (124)..(589): Pfam Name: RPE65 Pfam Description: Retinal pigment epithelial membrane protein
MASFTATAAVSGRWLGGNHTQPPLSSSQSSDLSYCSSLPMASRVTRKLNVSSALHTPPALHFPKQSSNSPAIVVKPKAKESNTKQMNLFQRAAAAALDAAEGFLVSHEKLHPLPKTADPSVQIAGNFAPVNEQPVRRNLPVVGKLPDSIKGVYVRNGANPLHEPVTGHHFFDGDGMVHAVKFEHGSASYACRFTQTNRFVQERQLGRPVFPKAIGELHGHTGIARLMLFYARAAAGIVDPAHGTGVANAGLVYFNGRLLAMSEDDLPYQVQITPNGDLKTVGRFDFDGQLESTMIAHPKVDPESGELFALSYDVVSKPYLKYFRFSPDGTKSPDVEIQLDQPTMMHDFAITENFVVVPDQQVVFKLPEMILGGSPVVYDKNKVARFGILDKYAEDSSNIKWIDAPDCFCFHLWNAWEEPETDEVVVIGSCMTPPDSIFNESDENLKSVLSEIRLNLKTGESTRRPIISNEDQQVNLEAGMVNRNMLGRKTKFAYLALAEPWPKVSGFAKVDLTTGEVKKHLYGDNRYGGEPLFLPGEGGEEDEGYILCFVHDEKTWKSELQIVNAVSLEVEATVKLPSRVPYGFHGTFIGADDLAKQVV

SEQ ID NO: 340 - protein, 599 aa, Arabidopsis lyrata
  misc_feature (1)..(599): Public GI ID no. 297834326
  misc_feature (1)..(599): Arabidopsis lyrata subsp. lyrata
  misc_feature (1)..(599): Bit score of 1157.8 for HMM based on sequences of Figure 2
  misc_feature (1)..(599): Functional Homolog Of SEQ ID NO. 337
  misc_feature (124)..(589): Pfam Name: RPE65 Pfam Description: Retinal pigment epithelial membrane protein
MASFTATAAVSRRWVGGNHTQPPLSSSQSSDLSYCSSLPMTSRVTRKLNVSSALHTPPALHFPKQSSNSPAIVVNPKAKESDTKQMNLFQRAAAAALDAAEGFLVRHERLHPLPKTSDPSVQIAGNFAPVNEQPVRRNLPVVGKIPDSIKGVYVRNGANPLHEPVTGHHFFDGDGMVHAVKFEDGSASYACRFTQTNRFIQESELGRPVFPKAIGELHGHTGIARLMLFYARAAAGIVDPAHGTGVANAGLVYFNGRLLAMSEDDLPYQVRITPSGDLKTVGRFDFDGQLESTMIAHPKVDPESGELFALSYDVVSKPYLKYFRFSPDGTKSPDVEIQLDQPTMMHDFAITENFVVIPDQQVVFKLPEMIRGGSPVVYDKNKVSRFGILDKYAEDSSNIKWIDAPDCFCFHLWNAWEEPETEEVVVIGSCMTPPDSIFNESDENLKSVLSEIRLNLKTGESTRRPIISDEDQQVNLEAGMVNRNMLGRKTKFAYLALAEPWPKVSGFAKVDLTTGEVKKHLYGDNRYGGEPLFLPGEGGEEDEGHILCFVHDEKTWTSELQIVNAVSLEVEATVKLPSRVPYGFHGTFIGADDLAKQVV

SEQ ID NO: 341 - protein, 599 aa, Chorispora bungeana
  misc_feature (1)..(599): Public GI ID no. 336420053
  misc_feature (1)..(599): Bit score of 1146.3 for HMM based on sequences of Figure 2
  misc_feature (1)..(599): Functional Homolog Of SEQ ID NO. 337
  misc_feature (124)..(590): Pfam Name: RPE65 Pfam Description: Retinal pigment epithelial membrane protein
MASFTTTAAVTRRWHGGNHSQPPLSSSPLRLESYSCSIPMTSRVQRKLNASSALHTPPALHFPKQSSNSPAIVVNPKPKESEAKQMNFFQRAAAAALDAAEGFLVSHERQHPLPKTADPSVQIAGNFAPVNEQPLRRNLPVVGKIPDSIKGVYVRNGANPLHEPVTGHHFFDGDGMVHAVKFEDGSASYACRFTQTNRFVQERELGRPVFPKAIGELHGHTGIARLMLFYARAAAGIVEPGQGTGVANAGLVYFNGRLLAMSEDDLPYQVRITPGGDLKTVGRFDFDGQLESTMIAHPKVDPESGELFALSYDVVSKPYLKYFRFSPDGKKSPDVEIQLDQPTMMHDFAITEKFVVVPDQQVVFKLPEMFRGGSPVVYDKNKVSRFGILDKYAEDSSNIKWIDVPDCFCFHLWNAWEEPETEEIVVIGSCMTPPDSIFNESDENLKSVLSEIRLNLKTGESNRRPIISDEDKQVNPEAGMVNRNMLGRKTKFAYLALAEPWPKVSGFAKVDLSTGEVKKHLYGENRYGGEPLFLPGDNEGGEDDGYILCFVHDEKTWKSELQIVNAVSLEVEATVKLPSRVPYGFHGTFIGASDLAKQV

SEQ ID NO: 342 - protein, 592 aa, Brassica napus
  misc_feature (1)..(592): Public GI ID no. 345451248
  misc_feature (1)..(592): Bit score of 1155.2 for HMM based on sequences of Figure 2
  misc_feature (1)..(592): Functional Homolog Of SEQ ID NO. 337
  misc_feature (1)..(592): in Figure 2
  misc_feature (117)..(583): Pfam Name: RPE65 Pfam Description: Retinal pigment epithelial membrane protein
MSSFTATAAVSRRWVGGNHTQPPLSSPQNSIPMTSRVQRKLNVSSALHTPPALHFPKQPTNSPAIAVNPKAKEPDTKQMNLFQRAAASALDAAEGLLVSHERQHQLPKTADPSVQIAGNFAPVNEQPVRRNLPVVGKIPDSIKGVYVRNGANPLHEPVTGHHFFDGDGMVHAVKFEDGTASYACRFTQTNRFIQERRLGRPVFPKAIGELHGHTGIARLMLFYARAAAGLVDPAHGTGVANAGLVYFNNRLLAMSEDDLPYQVRITPSGDLKTVGRYDFNGQLESTMIAHPKVDPESGELFALSYDVVSKPFLKYFRFSPEGIKSPDVEINLDQPTMMHDFAITENFVVIPDQQVVFKLPEMIRGGSPVVYDKEKVARFGVLDKYAGDSSAIRWIEAQECFCFHLWNAWEEPETEEIVVIGSCMTPPDSIFNEADENLESVLSEIRLNLRTGESTRRPIISDGEEQVNLEAGMVNRNMLGRKTRFAYLALAEPWPKVSGFAKVDLFTGEVKKYLYGGDRYGGEPLFLPGDENRAEDDGYILCFVHDEETWKSELQIVNAVSLEVEATVKLPSRVPYGFHGTFIGANDLATQV

SEQ ID NO: 343 - DNA, 1800 bp, Populus trichocarpa
  misc_feature (1)..(1800): Ceres Annot ID no. 1480808
  misc_feature (1)..(1800): Encodes the peptide sequence at SEQ ID NO. 344
atggcttcaacagcaacagcagtgccttcaaccttgggctcctcgtcattttcgtcttctttaaacaggcctggtagaaagcccaatgtcaacatcaattgctcactccaaactccttccattctccatttcccaaagcaatccactgcgtgcacaccatctactactatccccaatcccaccaccagacacccaaaacaaaacacgccctctcctgttgtggttgtgccccaaaagcaacagcagcaaaagcaatggaatttcttacaaagaacagcagctatggctttagatgctgttgaaactgccttggtttcacatgaacgtcagcaccctttgcccaaaacagctgaccccagagtccaaatctctggcaacttcgctccggtaccggaacagcccgtcgttcacaatttaccggtcaccggggaaatcccagatagcattcaaggtgtttatctaagaaacggagccaatccactgcacgagccagtagctggtcaccattttttcgatggtgatggcatggttcatgctgttcaattcaacaagggctcagtcagctattctagcagattcactgagactaataggctagttcaagaacgtgacttgggacgtcctttattcccaaaagccataggtgagctacatggtcattcaggcatagctagactcttgcttttttatgcccgtggagcttttggtattgttgatcctagccatggaactggtgttgcaaacgctggtcttgtttactttgatggtcacttacttgcaatgtctgaagatgatttgccataccatgttcgtgtactgccctctggtgaccttaagacagttggtcgttatgattttgatggtcagcttaagacaacaatgattgctcatccaaaagttgatccagtttcaggtgaattgtttgcacttagttatgatgttgttcaaaagccttacctcaagtacttcagattctccccggatggaaaaaagtcacctgatgttgaaatctcacttgatcaacctactatgatgcatgattttgcaatcacagagaggtttgttgtggttcctgatcagcaagttgtgttcaaattgcctgaaatgattcggggagggtctccggtgatttatgacaagaataagatggcaaggtttgggattttggacaagaatgccactgatgcttccaatatgaggtggattgaaacacctgactgtttctgtttccatctttggaacgcttgggaggagcctgagactgatgaggttgttgtgattggatcatgtatgaccccaccagactccattttcaatgaatgtgatgagagtttgaaaagtgtgttatcagaaattaggctcaatttgaagactggcaagtcaactcgccgtccaatcatgtctgaagctgatcaggtcaatttagaagctggaatggtgaaccggaacttgctcggtcgaaagacccggttcgcttacttagcacttgctgagccatggcctaaggtttcaggttttgctaaggtagacctctcaactggggaggtacacaagcacacttacggagaccagaaatttggcggagagcccttgtttcttccacgagaccccaattcggagagggaagatgacgggtacattttagctttcgtgcatgatgagaaggagtggaaatcggagctacaaattgtgaatgcaatgaatttaaagttagaagccacagttaagattccatctagagttccatatggttttcatggcacatttattggtgccaaggatttggagaagcaggcctag

SEQ ID NO: 344 - protein, 599 aa, Populus trichocarpa
  misc_feature (1)..(599): Ceres Annot ID no. 1480808
  misc_feature (1)..(599): Bit score of 1152.6 for HMM based on sequences of Figure 2
  misc_feature (1)..(599): Functional Homolog Of SEQ ID NO. 337
  misc_feature (124)..(590): Pfam Name: RPE65 Pfam Description: Retinal pigment epithelial membrane protein
MASTATAVPSTLGSSSFSSSLNRPGRKPNVNINCSLQTPSILHFPKQSTACTPSTTIPNPTTRHPKQNTPSPVVVVPQKQQQQKQWNFLQRTAAMALDAVETALVSHERQHPLPKTADPRVQISGNFAPVPEQPVVHNLPVTGEIPDSIQGVYLRNGANPLHEPVAGHHFFDGDGMVHAVQFNKGSVSYSSRFTETNRLVQERDLGRPLFPKAIGELHGHSGIARLLLFYARGAFGIVDPSHGTGVANAGLVYFDGHLLAMSEDDLPYHVRVLPSGDLKTVGRYDFDGQLKTTMIAHPKVDPVSGELFALSYDVVQKPYLKYFRFSPDGKKSPDVEISLDQPTMMHDFAITERFVVVPDQQVVFKLPEMIRGGSPVIYDKNKMARFGILDKNATDASNMRWIETPDCFCFHLWNAWEEPETDEVVVIGSCMTPPDSIFNECDESLKSVLSEIRLNLKTGKSTRRPIMSEADQVNLEAGMVNRNLLGRKTRFAYLALAEPWPKVSGFAKVDLSTGEVHKHTYGDQKFGGEPLFLPRDPNSEREDDGYILAFVHDEKEWKSELQIVNAMNLKLEATVKIPSRVPYGFHGTFIGAKDLEKQA

SEQ ID NO: 345 - protein, 606 aa, Citrus sinensis
  misc_feature (1)..(606): Public GI ID no. 355398706
  misc_feature (1)..(606): Bit score of 1126.2 for HMM based on sequences of Figure 2
  misc_feature (1)..(606): Functional Homolog Of SEQ ID NO. 337
  misc_feature (131)..(598): Pfam Name: RPE65 Pfam Description: Retinal pigment epithelial membrane protein
MAAATTTSSLIDLGSCKDSCSSPSFSSSRARIAFSLKKPTEITCSLQTPSILHFPKQSPKYPPSPAASPPPSSPPLTTKQQPKENDNFAPSKWNFLQKAAALALDAVENALVSQERQHPLPKTADPTVQIAGNFSPVPEKPVCQNLPTTGKVPDCIQGVYVRNGANPLHEPVAGHHFFDGDGMVHAVQFNKGSVSYSCRFTETNRFVQERSLGRPVFPKAIGELHGHTGIARLLLFYSRALFGLVDPSHGTGVANAGLVYFNNRLLAMSEDDLPYHVRVTPSGDLKTVGRFDFSGQLKSTMIAHPKVDPVTGDLFALSYDVVKKPYLKYFRFSPQGIKSPDVEIPLEEPTMMHDFAITENFVVVPDQQVVFKLNEMIRGGSPVIYDKNKVSRFGILDKNATDASKMKWIDAPDCFCFHLWNAWEEPERDEVVVIGSCMTPADSIFNECDESLKSVLSEIRLNLKTGESTRRPLISEDEQVNLEAGMVNRNLLGRKTRFAYLALAEPWPKVSGFAKVDLLTGQVNKFIYGGQRYGGEPLFFPRDPNSENEDDGYILAFVHDEKEWKSELQIVNAMTLELEATVKLPSQVPYGFHGTFISAKDLAKQA

SEQ ID NO: 346 - DNA, 1779 bp, Populus trichocarpa
  misc_feature (1)..(1779): Ceres Annot ID no. 1519993
  misc_feature (1)..(1779): Encodes the peptide sequence at SEQ ID NO. 347
atggcttcagcagcagcagcagcgaacttgggctcatcatcttcatctttaaagaggcctggtaaaaagcccaacacccattgctctctccaaaccccttccactcttcatttcccgaagcaatccactacatacacaccatcatccactactatttccactcccaccaccaaacacccaaaacgagacactccctctcctgttgcgccttctccaaaacaacagcaaaagcaatggaatttcttacaaagtgctgcagctatggctttagatgctgttgagactgctttagtttcacatgaacgtcaacaccctctacccaaaacagctgaccccggagtccaaatctctggcaacttcgctccggtaccggagcaacctgtcgttcaagatttaccggtcaccggaaaaatcccagattgtattcaaggtgcttatcttagaaacggagccaacccatttcatgagccagtagctggtcaccatttctttgatggggatggcatggttcatgctgttcagttcaagaagggttcagtcagctattctagcaggttcactgagactaataggcttgttcaagaacgtgggttgggacgtcctttattcccaaaggccataggtgagctacatggtcattcgggcatagctaggctcttgctcttttatgctcgtggagcttttggtattgttgatcctagccatggcactggtgttgcaaacgctggtcttgtttactttgatggtcacttactggcaatgtctgaagatgatttgccttaccatgttcgtgtacttccctctggtgaccttcagactgttggacgatatgattttgatggtcagcttaagacaacaatgattgctcatccaaaagttgatccagtctcaggtgaattgttcgcacttagttatgatgttgttcaaaagccttacctcaagtacttcagattctcccccgatggtaaaaagtcgcccaatgttgaaatcccacttgatcaacctactatgatgcatgattttgctatcacagagaggtttgttgtggtacctgatcagcaagttgtgttcaaattgcctgaaatgattcggggaggatctccggtgatttatgacaagaataagatggcaaggtttgggattttggacaagaatgccactgatgcttccaatattaggtggattgaaacacctgactgcttctgttttcatctttggaatgcttgggaggagcctgagactgatgaggttgttgtgattggttcatgtatgaccccgccggactccatttttaatgaatgtgatgagagtttgaaaagtgtgctatcagaaatcaggctcaatttgaagaccggcaagtctactcgccgtcagatcctgtctgaagctgatcaggtcaatttagaagctggaatggtgaaccggaacttgctcggtcgaaaatcccggtttgcttacttagcactggctgagccatggcctaaagtttcaggttttgccaaagtagacctctcaactggagaggtacacaagtatatttatggagaccagaaattcggtggagagcctttgtttcttccacgagaccccaattcagagagggaagatgacgggtacattttagctttcgtgcatgatgagaaggaatggaaatcagagctgcaaattgtgaatgcaatgaatttaaagttagaagccacagttaagcttccatcgagagttccatatggctttcatggcacgtttattggtgccaaggatttggagaaacaggcctag

SEQ ID NO: 347 - protein, 592 aa, Populus trichocarpa
  misc_feature (1)..(592): Ceres Annot ID no. 1519993
  misc_feature (1)..(592): Bit score of 1160.5 for HMM based on sequences of Figure 2
  misc_feature (1)..(592): Functional Homolog Of SEQ ID NO. 337
  misc_feature (1)..(592): in Figure 2
  misc_feature (117)..(583): Pfam Name: RPE65 Pfam Description: Retinal pigment epithelial membrane protein
MASAAAAANLGSSSSSLKRPGKKPNTHCSLQTPSTLHFPKQSTTYTPSSTTISTPTTKHPKRDTPSPVAPSPKQQQKQWNFLQSAAAMALDAVETALVSHERQHPLPKTADPGVQISGNFAPVPEQPVVQDLPVTGKIPDCIQGAYLRNGANPFHEPVAGHHFFDGDGMVHAVQFKKGSVSYSSRFTETNRLVQERGLGRPLFPKAIGELHGHSGIARLLLFYARGAFGIVDPSHGTGVANAGLVYFDGHLLAMSEDDLPYHVRVLPSGDLQTVGRYDFDGQLKTTMIAHPKVDPVSGELFALSYDVVQKPYLKYFRFSPDGKKSPNVEIPLDQPTMMHDFAITERFVVVPDQQVVFKLPEMIRGGSPVIYDKNKMARFGILDKNATDASNIRWIETPDCFCFHLWNAWEEPETDEVVVIGSCMTPPDSIFNECDESLKSVLSEIRLNLKTGKSTRRQILSEADQVNLEAGMVNRNLLGRKSRFAYLALAEPWPKVSGFAKVDLSTGEVHKYIYGDQKFGGEPLFLPRDPNSEREDDGYILAFVHDEKEWKSELQIVNAMNLKLEATVKLPSRVPYGFHGTFIGAKDLEKQA

SEQ ID NO: 348 - protein, 604 aa, Solanum tuberosum
  misc_feature (1)..(604): Public GI ID no. 7209269
  misc_feature (1)..(604): Bit score of 1162.6 for HMM based on sequences of Figure 2
  misc_feature (1)..(604): Functional Homolog Of SEQ ID NO. 337
  misc_feature (128)..(596): Pfam Name: RPE65 Pfam Description: Retinal pigment epithelial membrane protein
MATTTSHATNTWIKPKLSMPSSKEFGFASNSISLLKNQHNRQSLNINSSLQAPPILHFPKQSSNYQTPKTSTISHPKQENNNSSSSISKWNLVQKAAAMALDAVEGALTKHELEHPLPKTADPRVQISGNFAPVPENPVCQSLPVTGKIPKCVQGVYVRNGANPLFEPTAGRHFFDGDGMVHAVQFKNGSASYACRFTETERFVQEKALGRPVFPKAIGELHGHSGIARLMLFYARGLFGLIDHSRGTGVANAGLVYFNNRLLAMSEDDLPYHVKVTPTGDLKTEGRFDFDGQLKSTMIAHPKLDPVSGELFALSYDVIQKPYLKYFRFSKNGEKSNDVEIPVEDPTMMHDFAITEKFVIIPDQQVVFKMSEMIRGGSPVVYDKNKVSRFGILDKYAKDGSDLKWVEVPDCFCFHLWNAWEEPETDEIVVIGSCMTPPDSIFNECDEGLKSVLSEIRLNLKTGKSTRKAIIENPDEQVNLEAGMVNRNKLGRKTQYAYLAIAEPWPKVSGFAKVDLFTGEVEKFIYGDNKYGGEPLFLPRDPNSKEEDDGYILAFVHDEKEWTSELQIVNAMTLKLEATVKLPSRVPYGFHGTFINANDLANQA

SEQ ID NO: 349 - DNA, 2317 bp, Gossypium hirsutum
  misc_feature (1)..(2317): Ceres Clone ID no. 1943815
  misc_feature (1)..(2317): Encodes the peptide sequence at SEQ ID NO. 350
attcatactcactcactcaccatttctcttcacctacaaaagaaaaagggtctttctcaagcacacataaaagtatagaatctttgagtcttaattattttgtattctttttcaaaaccaatcaagtttcaccattcataacgaagcttacataaccactagtaattggcttagccttatggcttcatcaacagcagcatcagtggctagtgggagctgttgtgttaaggttaaactccctgtttcaactcctcagtcttcgtcttcttcttcttcttgtattggttttaaaaagcgctacatttcatgttctttgcaaacccattcaattcttcatttgcctaagcaacaattaccagcttttccaccatcaccttcttctactcctccaacgaaaaacaccgagaaaactactcaatcccaacaatggaatcctttgcaaagagcggcggctatggctttagatgcggtggagaatgctttggtttctcatgagcgtcaacatcctttgccgaaaacagctgaccctggtgaacaaatttccggtaactttgctccggtccctgaacaaactgttaaacaaaggcttcccgttattggaacaatcccggattgcatacaaggagtctacgctcgaaacggtgccaacccgcttcatgaaccggtggctggacaccatttcttcgatggggatgggatggttcatgcggttcagttcaaaaatggctcagctagctatgcttgtaggttcactgaaaccaaccgtttggttcaagaacgagcttttgggcgtcctgttttccctaaagccataggtgaactccatggtcattcaggcatagctagactgttacttttctatgctcgaggtttatgtggactcgttgatccaagccatggcactggtgttgctaacgcgggacttgtttacttcaacggccaccttctagccatgtctgaagatgatttgccgtaccatgttcgtattactccatctggtgacttgaaaaccattggcagatacaattttgatggtcagttgaaatccacaatgattgctcaccccaaagttgatccacaaactggtgaattctttgctcttagctatgatgttatccaaaaaccgcatctcaagtactttaaaatttcacccggtggtaagaaatcacctgatgttgaaatcccagttgatggtccaacaatgatgcacgacttcgccatcactgaaaattttgtggtgataccagaccaacaagttgttttcaaattgggtgaaatggttcatggtggttcacccgttgtgtatgataagaacaaggtatcaaggtttggggtattgaacaagaatgccattgatgcttctgggattaaatggattgaagcacctgattgcttttgtttccatctttggaatgcttgggaagaaccagaaactaacgaagttgttgtgattggttcttgcatgacacccccagattccattttcaatgaatgtgaagagaatctcaagagtgttctgtctgaaattagattgaatttgaagaccgggaaatcgactcgccgtgccattatttctgaatccgagcaagtgaacttggaagcagggatggtgaacaagaatttactgggaagaaagactcggtttgcatatttagctctagctgagccttggcctaaagtgtcaggattcgccaaagtcgatctctcgaccggggaagttaacaagtatatctatggagatcaaaggtatggtggtgagcctttgttcttccctcgaaacccccattcggagaacgaagacgacggctatattttagccttcgttcacgacgagaagacttggaaatcggaactgcaaattgtgaacgccatggacttaaagctagaagccacggttcaacttccgtctcgagttccatacggttttcatggaacattcataagctcaaaggacttggaaaaacaggcctaatttcatcagccattttgtaaaaaagggagaggttttaccagagggatgctttgcatggattgtccccggaatctcttcctctgttttaaaccctgttttttttttagtccctacacttttaaaaatctccttttttggtcactattgtaaagtgaaaaaggttttggggataccagcttgtagcttttgctttagctagtattgaagctcagctggtttctgcttattatttcacttatcttcattaaacagtacataaattacagggaaaaatgtactattttcctctgttttatctctgtaattctgtgtttccttgtgaatacttgaaaatttacagtgtat

SEQ ID NO: 350 - protein, 597 aa, Gossypium hirsutum
  misc_feature (1)..(597): Ceres Clone ID no. 1943815
  misc_feature (1)..(597): Bit score of 1113.4 for HMM based on sequences of Figure 2
  misc_feature (1)..(597): Functional Homolog Of SEQ ID NO. 337
  misc_feature (122)..(589): Pfam Name: RPE65 Pfam Description: Retinal pigment epithelial membrane protein
MASSTAASVASGSCCVKVKLPVSTPQSSSSSSSCIGFKKRYISCSLQTHSILHLPKQQLPAFPPSPSSTPPTKNTEKTTQSQQWNPLQRAAAMALDAVENALVSHERQHPLPKTADPGEQISGNFAPVPEQTVKQRLPVIGTIPDCIQGVYARNGANPLHEPVAGHHFFDGDGMVHAVQFKNGSASYACRFTETNRLVQERAFGRPVFPKAIGELHGHSGIARLLLFYARGLCGLVDPSHGTGVANAGLVYFNGHLLAMSEDDLPYHVRITPSGDLKTIGRYNFDGQLKSTMIAHPKVDPQTGEFFALSYDVIQKPHLKYFKISPGGKKSPDVEIPVDGPTMMHDFAITENFVVIPDQQVVFKLGEMVHGGSPVVYDKNKVSRFGVLNKNAIDASGIKWIEAPDCFCFHLWNAWEEPETNEVVVIGSCMTPPDSIFNECEENLKSVLSEIRLNLKTGKSTRRAIISESEQVNLEAGMVNKNLLGRKTRFAYLALAEPWPKVSGFAKVDLSTGEVNKYIYGDQRYGGEPLFFPRNPHSENEDDGYILAFVHDEKTWKSELQIVNAMDLKLEATVQLPSRVPYGFHGTFISSKDLEKQA

SEQ ID NO: 351 - DNA, 1818 bp, Solanum lycopersicum
  misc_feature (1)..(1818): Ceres Annot ID no. 1138943
  misc_feature (1)..(1818): Encodes the peptide sequence at SEQ ID NO. 352
atggcaactactacttcacatgccacaaatacatggattaagactaagttgtcaatgccatcatcaaaggagtttggttttgcatcaaactctatttctctactcaaaaatcaacataataggcaaagtctcaacattaattcctctcttcaagctccacctatacttcattttcctaaacaatcttcaaattatcaaacaccaaagaataatacaatttcacacccaaaacaagaaaacaacaactcctcttcttcttcaacttccaagtggaatttagtgcagaaagcagcagcaatggctttagatgctgtagaaagtgctttaactaaacatgaacttgaacaccctttgccgaaaacagccgacccacgagtccagatttctgggaattttgctccggtaccggaaaatccagtctgtcaatctcttccggtcaccggaaaaatacccaaatgtgttcaaggcgtttacgttcgaaacggagctaaccctctttttgaaccaaccgccggacaccatttcttcgacggcgacggtatggttcacgccgttcaattcaaaaatgggtcggctagttacgcttgccgtttcactgaaacagagaggcttgttcaagaaaaagctttgggtcgccctgttttccctaaagccattggtgaattacatggtcactctggaattgcaaggcttatgctgttttacgctcgtgggctcttcggacttgttgatcacagtaaaggaactggtgttgcaaacgccggtttagtctatttcaataaccgattacttgctatgtctgaagatgatttgccttaccatgtaaaggtaacacccaccggcgatcttaaaacagagggtcgattcgatttcgacggccagctaaaatccaccatgatagctcacccaaagctcgacccagtttccggtgagctatttgctcttagctacgatgtgattcagaagccatacctcaagtacttcagattttcaaaaaatggggaaaaatcaaatgatgttgaaattccagttgaagacccaacaatgatgcatgatttcgcaattactgagaacttcgtcgtcattcctgatcaacaagtcgttttcaagatgtctgaaatgatccgtggaggttcaccggtggtttacgacaagaacaaagtttcccgatttggtattctggataagtacgcgaaagatgggtctgatttgaaatgggttgaagtacctgattgtttctgtttccacctctggaatgcttgggaagaagcagaaacagatgaaatcgttgtaattggttcatgtatgacaccaccagactccattttcaatgaatgtgatgaagggctaaagagtgttttatccgaaatccgtctcaatttgaaaacagggaaatcaacaagaaaatccataatcgaaaacccggatgaacaagtgaatttagaagctggaatggtgaaccgaaacaaactcggaaggaaaacagagtatgcttatttggctatcgctgaaccatggccaaaagtttctggttttgcaaaagtaaacctgttcaccggtgaagttgagaaattcatttatggtgacaacaaatatggtggggaacctctttttttaccaagagaccccaacagcaaggaagaagacgatggttatattttagctttcgttcacgatgagaaagaatggaaatcagaactgcaaattgttaacgcaatgagtttgaagttggaggcaactgtgaagcttccatcaagagttccttatggatttcatggaacattcataaacgccaatgatttggcaaatcaggcatga

SEQ ID NO: 352 - protein, 605 aa, Solanum lycopersicum
  misc_feature (1)..(605): Ceres Annot ID no. 1138943
  misc_feature (1)..(605): Bit score of 1178.0 for HMM based on sequences of Figure 2
  misc_feature (1)..(605): Functional Homolog Of SEQ ID NO. 337
  misc_feature (1)..(605): in Figure 2
  misc_feature (129)..(597): Pfam Name: RPE65 Pfam Description: Retinal pigment epithelial membrane protein
MATTTSHATNTWIKTKLSMPSSKEFGFASNSISLLKNQHNRQSLNINSSLQAPPILHFPKQSSNYQTPKNNTISHPKQENNNSSSSSTSKWNLVQKAAAMALDAVESALTKHELEHPLPKTADPRVQISGNFAPVPENPVCQSLPVTGKIPKCVQGVYVRNGANPLFEPTAGHHFFDGDGMVHAVQFKNGSASYACRFTETERLVQEKALGRPVFPKAIGELHGHSGIARLMLFYARGLFGLVDHSKGTGVANAGLVYFNNRLLAMSEDDLPYHVKVTPTGDLKTEGRFDFDGQLKSTMIAHPKLDPVSGELFALSYDVIQKPYLKYFRFSKNGEKSNDVEIPVEDPTMMHDFAITENFVVIPDQQVVFKMSEMIRGGSPVVYDKNKVSRFGILDKYAKDGSDLKWVEVPDCFCFHLWNAWEEAETDEIVVIGSCMTPPDSIFNECDEGLKSVLSEIRLNLKTGKSTRKSIIENPDEQVNLEAGMVNRNKLGRKTEYAYLAIAEPWPKVSGFAKVNLFTGEVEKFIYGDNKYGGEPLFLPRDPNSKEEDDGYILAFVHDEKEWKSELQIVNAMSLKLEATVKLPSRVPYGFHGTFINANDLANQA

SEQ ID NO: 353 - protein, 610 aa, Vitis vinifera
  misc_feature (1)..(610): Public GI ID no. 38112198
  misc_feature (1)..(610): Bit score of 1115.6 for HMM based on sequences of Figure 2
  misc_feature (1)..(610): Functional Homolog Of SEQ ID NO. 337
  misc_feature (135)..(602): Pfam Name: RPE65 Pfam Description: Retinal pigment epithelial membrane protein
MASPAAAAASTPNISACVKPKLCYSSSSSSSSSSSALDLGSFSFHRPTIRPNINCSLHSPSVLHFPKHTSSSTGVATVKTTLPKEKDDFSSSVSQQWNFLQSAAAMALDAVETALVARETQHPLPKTADPRVQIAGNFAPVPEQPVQHSLPVDGRIPDCIQGVYTRNGANPLHKPVAGHHLFDGDGMVHAVQFKDGDASYACRFTETQRLIQERDFGRPVFPKAIGELHGHSGIARLLLFYARGLFGLVDHSHGTGVANAGLVYFNRRLLAMSEDDLPYQIRVTPSGDLETVGRYDFEGQLRSTMIAHPKVDPVSGEMFALSYDVVQKPYLKYFRFSPKGDKSPDVEIPLAEPTMMHDFAITERFVVVPNQQVVFKLQEMISGGSPVVYDKNKMSRFGVLDKNATDASGMLWIEAPDCFCFHLWNAWEEPETDEVVVIGSCMTPPDSIFNECDEGLKSVLSEIRLNLKTGKSTRRPILPESEQVNLEAGMVNRNRLGRKTQFAYLAVAEPWPKVSGFAKVDLSTGQVSKYIYGEQRYGGEPLFLPRDPNSGREDDGYILAFVHDEKTWKSELQIVNATNLQLEASVKLPSRVPYGFHGTFISSKELEKQA

SEQ ID NO: 354 - protein, 588 aa, Daucus carota
  misc_feature (1)..(588): Public GI ID no. 79155296
  misc_feature (1)..(588): Daucus carota subsp. sativus
  misc_feature (1)..(588): Bit score of 1102.1 for HMM based on sequences of Figure 2
  misc_feature (1)..(588): Functional Homolog Of SEQ ID NO. 337
  misc_feature (113)..(580): Pfam Name: RPE65 Pfam Description: Retinal pigment epithelial membrane protein
MATYATWAKPKILTSCPQREVKSQKAYRKNNVNCSLQSPSILHFPKQSPHIYQTPCVPTTIAQPKHQDSSSSNQWNFLQKAASMALDAVENVIAAREKEHPLPKTADPQVQIAGNFAPVPEQPVRHRLPVTGKIPECISGVYVRNGANPHLEPTAGHHFFDGDGMVHAVQFKEGAASYACRFTETERLIQERNLGKPVFPKAIGELHGHSGIARLALFYARGLFGLVDHSQGTGVANAGLVYFNNRLLAMSEDDLPYHVEITSSGDLKTVGRYNFDGQLDTTMIAHPKIDPDTKELIALSYNVIQKPYLKYFRVSPDGVKSDDVDIELADPTMMHDFAITENFVVIPDQQVVFKISEMIQGGSPVVYDKNKVSRFGVLDKYAKDGSGIKWVEVPDCFCFHLWNAWEDEESDEIVVIGSCMTPADSIFNECDEGLQSVLSEIRLNLKTGKSTRKPIMSSEDQVNLEAGMVNKNKLGRKTQFAYLAIAEPWPKVSGFAKVDLFTGQVQKFFYGDHKYGGEPLFLPKNPNSENEDDGYILAFVHDEKAWKSELQIVNAMTLELEATVQLPSRVPYGFHGTFISAKDLESQA

SEQ ID NO: 355 - protein, 609 aa, Fragaria x ananassa
  misc_feature (1)..(609): Public GI ID no. 317016344
  misc_feature (1)..(609): Bit score of 1052.5 for HMM based on sequences of Figure 2
  misc_feature (1)..(609): Functional Homolog Of SEQ ID NO. 337
  misc_feature (134)..(601): Pfam Name: RPE65 Pfam Description: Retinal pigment epithelial membrane protein
MATPSNSWAHTAQIPHHLSTTSSTSSSSSLLNMSFPKRSVALNRNRTVTAHSALQSPSVLNFPKQPYHQQVITKEATSSPSAKPKTATTTQQPPHWNFLQRAASTALDMLEGALVSRESRSPLPKTADPRVQIAGNFAPVPEQPVRHSLSISGTIPECISGVYVRNGANPLHEPVAGHHFFDGDGMVHAVSINDGAASYACRFTETQRLVQEREIGRPVFPKAIGELHGHSGIARLALFYARGALGLVNPSQGIGVANAGLVYFNDRLLAMSEDDMPYQVRITPSGDIETVGRYDFETQLGSTMIAHPKVDPVSGHLHTLSYDIVKMPYLKYFQFSANGEKSPDVEIPLAAPTMMHDFAITENFVVIPDQQVVFKLQEMITGGSPVIYDQNKKSRFGILAKNATNADDIIWVESPDTFCFHLWNAWEEPESDEVVVIGSCMTPPDSIFNECDESLKSVLSEIRLNLKTGESKRRPIISEEADHVNLEAGMVNRNLLGRKTRYAYLAIAEPWPKVSGFAKVDLFTGEVKKHIYGDRKFGGEPFFLPSSSTGEEDEGYILSFVHDEKTWKSELQIVNAVSLKVEATVTLPSRVPYGFHGTFIDSKALKNQA

SEQ ID NO: 356 - protein, 615 aa, Phaseolus vulgaris
  misc_feature (1)..(615): Public GI ID no. 75185609
  misc_feature (1)..(615): Bit score of 1073.3 for HMM based on sequences of Figure 2
  misc_feature (1)..(615): Functional Homolog Of SEQ ID NO. 337
  misc_feature (143)..(607): Pfam Name: RPE65 Pfam Description: Retinal pigment epithelial membrane protein
MPSPASNTWINTTLPSSCSSPFKDLASTSSSPTTLLPFKKRSSSNTNTITCSLQTLHYPKQYQPTSTSTTTTPTPIKPTTTTTTTTPHRETKPLSDTKQPFPQKWNFLQKAAATGLDMVETALVSHESKHPLPKTADPKVQIAGNFAPVPEHAADQALPVVGKIPKCIDGVYVRNGANPLYEPVAGHHFFDGDGMVHAVKFTNGAASYACRFTETQRLAQEKSLGRPVFPKAIGELHGHSGIARLLLFYARSLFQLVDGSHGMGVANAGLVYFNNHLLAMSEDDLPYHVRITSNGDLTTVGRYDFNGQLNSTMIAHPKLDPVNGDLHALSYDVVQKPYLKYFRFSADGVKSPDVEIPLKEPTMMHDFAITENFVVVPDQQVVFKLTEMITGGSPVVYDKNKTSRFGILDKNAKDANAMRWIDAPECFCFHLWNAWEEPETDEIVVIGSCMTPADSIFNECDESLKSVLSEIRLNLRTGKSTRRPIISDAEQVNLEAGMVNRNKLGRKTQFAYLALAEPWPKVSGFAKVDLFSGEVQKYMYGEEKFGGEPLFLPNGEEEGDGYILAFVHDEKEWKSELQIVNAQNLKLEASIKLPSRVPYGFHGTFIHSKDLRKQA

SEQ ID NO: 357 - protein, 601 aa, Pisum sativum
  misc_feature (1)..(601): Public GI ID no. 22335699
  misc_feature (1)..(601): Bit score of 1065.7 for HMM based on sequences of Figure 2
  misc_feature (1)..(601): Functional Homolog Of SEQ ID NO. 337
  misc_feature (127)..(593): Pfam Name: RPE65 Pfam Description: Retinal pigment epithelial membrane protein
MATFTASPSNTWINTKSSSRTNSSSILLNKKRSTSKNTISCSLQTTLPFPKKYQPQSTNTTTTTLIPTRETKPNLPSNTKPLHKQEQKWNLLQQAAATTLDFVETTLIKQESKHPLPKTSDPRVQIAGNFAPVPEHPVTQNLPITGKLPKGIDGVYLRNGANPLHEPVAGHHFFDGDGMVHAVKFTNGSVSYSCRFTETHRLAQEKALGRPVFPKAIGELHGHSGIARLMLYYARSLCGLVDGTHGMGVANAGLVYFNNRLLAMSEDDIPYHVRVTPNGDLTTVCRYDFNDQLKSTMIAHPKVDPVDKNLYALSYDVVQKPYLKYFRFDSNGVKSPDVEIPLAEPTMMHDFAITENFVVVPDQQVVFKLGEMIRGGSPVVYDKEKVSRFGVLSKNAENASEMKWIDAPECFCFHLWNAWEEPENDEVVVIGSCMTPADSIFNECDESLKSVLSEIRLNLKTGKSTRRAIIQESEHMNLEAGMVNKNKLGRKTQFAYLALAEPWPKVSGFAKVDLFSGEVKKYLYGENRFGGEPLFLPNEDSENEDDGYILTFVHDEKEWKSEIQIVNAVNLKLEACIPLPSRVPYGFHGTFIHSKELEKQE

SEQ ID NO: 358 - protein, 587 aa, Glycine max
  misc_feature (1)..(587): Public GI ID no. 359806478
  misc_feature (1)..(587): Bit score of 956.0 for HMM based on sequences of Figure 2
  misc_feature (1)..(587): Functional Homolog Of SEQ ID NO. 337
  misc_feature (121)..(585): Pfam Name: RPE65 Pfam Description: Retinal pigment epithelial membrane protein
MAALNSSTCAKPQFPHPLSSSFSSSSSLTRDLGFPTRFQKKPIRKVVDCALHSPPVIHFPNQPYNKPEITKEPTTSTAERPQWNPFQKAAAKALDMFESALLSRELNQPFPKTTDPRVQIAGNFAPVPEHPVEHSLPVIGTIPDAINGVYLRNGANPLFKPKAGHHLFDGDGMVHAVKFNDGTASYACRFTETQRLMQERKLGKPVFPKAIGELHGHSGIARLMLFYARGLCGIVDHRRGAGAANAGLVFFNGKLLAMSEDDFPYELRITASGDLETIGRYSFHGQLNSSMIAHPKVDPVSGELFTLSYDVTSKILKYFHFSPEDERKSPDIEIPLDAPTMTHDFAITENFVVIPDQQVVFKLGEMIKGGSPVIYDGEKKSRFGILPKYASDASSIVWVDSPDTFFFHFWNAWEERDKDEVVVIGSCMTPPDSIFNDREERLKSVLTEVRLNMRSGKARRRVLVEEMNLEAGMVNRKRLGRKTRFAYLCIAEPWPKVSGVAKVDLESGEVKRHEYGERRFGGEPFFLPTRGGNGNEDEGYVMAFVHDEMTWQSELQILNALDLKLEATVMLPSRVPYGFHGTFVEAH

SEQ ID NO: 359 - protein, 607 aa, Hordeum vulgare
  misc_feature (1)..(607): Public GI ID no. 112181145
  misc_feature (1)..(607): Hordeum vulgare subsp. vulgare
  misc_feature (1)..(607): Bit score of 1112.0 for HMM based on sequences of Figure 2
  misc_feature (1)..(607): Functional Homolog Of SEQ ID NO. 337
  misc_feature (128)..(598): Pfam Name: RPE65 Pfam Description: Retinal pigment epithelial membrane protein
MQTLSAQPLASSSSIQRHHGRRRGPGSVRFAPRAAAAAAATSTSTARSPAYVSSPSTRKVPGYEQSSPPAIASPQKQGSSGGEGEQSLNFFQRAAAAALDAFEEGFINNVLERPHALPRTADPAVQIAGNFAPVGEQPPVRALTVSGRIPPFINGVYARNGANPCFEPTAGHHLFDGDGMVHAIRIRNGAAESYACRFTETARLSQERAAGRPVFPKTIGELHGHSGIARLALFYARGACGLVDPSHGTGVANAGLVYFNGRLLAMSEDDLPYQVRVTAGGDLETVGRYDFDGQLDCAMIAHPKLDPVSGELFALSYDVIKKPYLKYFYFHADGTKSADVEIELDQPTMIHDFAITENFVVVPDHQMVFKLAEMFRGGSPVMLDKEKTSRFGVLPKYAKDSSEMMWVDVPDCFCFHLWNSWEEPETDEVVVIGSCMTPADSIFNDTDDHLESVLTEIRLNTRTGESTRRAILPLESQVNLEVGMVNRNMLGRKTRYAYLAVAEPWPKVSGFAKVDLVTGELTKFEYGEGRFGGEPCFVPMDGEHARPGAEDDGYVLSFVRDEDAGTSELLVVNAADMRLEATVQLPSRVPYGFHGTFIGDADLDAQH

SEQ ID NO: 360 - protein, 608 aa, Oryza sativa
  misc_feature (1)..(608): Public GI ID no. 115454329
  misc_feature (1)..(608): Oryza sativa Japonica Group
  misc_feature (1)..(608): Bit score of 1159.6 for HMM based on sequences of Figure 2
  misc_feature (1)..(608): Functional Homolog Of SEQ ID NO. 337
  misc_feature (129)..(600): Pfam Name: RPE65 Pfam Description: Retinal pigment epithelial membrane protein
MATITTPGYAHIQRQHGRCSTTAGRRGASNSVRFSARAVSSVPHAAAASSAPAFLPVPFVPGADAPSPSGKSAIGVPKAPRKGEEGKRLNFFQRAAAMALDAFEEGFVANVLERPHGLPSTADPAVQIAGNFAPVGETPPARALPVSGRIPPFINGVYARNGANPHFDPVAGHHLFDGDGMVHAVRIRNGAAESYACRFTETARLRQERAMGRPMFPKAIGELHGHSGIARLALFYARAACGLLDPSHGTGVANAGLIYFNGRLLAMSEDDLPYQVRVTADGDLETVGRYDFDGQLGCAMIAHPKLDPATGELHALSYDVIKKPYLKYFYFAPDGTKSADVEIPLDQPTMIHDFAITENYVVVPDHQVVFKLQEMLRGGSPVVLDKEKTSRFGVLPKHAADASEMVWVDVPDCFCFHLWNAWEEADTDEVVVIGSCMTPADSIFNESDDRLESVLTEIRLNTRTGESTRRAILPPSSQVNLEVGMVNRNLLGRKTRYAYLAVAEPWPKVSGFAKVDLATGELTKFEYGEGRFGGEPCFVPMDAAAATPRGEDDGYILSFVHDERAGTSELLVVNAADMRLEATVQLPSRVPYGFHGTFITGDELTTQA

SEQ ID NO: 361 - DNA, 2549 bp, Panicum virgatum
  misc_feature (1)..(2549): Ceres Clone ID no. 1806409
  misc_feature (1)..(2549): Encodes the peptide sequence at SEQ ID NO. 362
aaaaccatccgctcccccggacaccgcaccaacgggctcgctcgctccagcctccgccccctcgccgcacacctccgtaaaacccacccgattccgcctaaaccacccaccgcgatcctcgacaattcagcggccgcgatgcagggtctcgccccgcccacctctgtttccatacaccggcgcccgccggccgggtccagggcggcccggggccccagctcggtgaggttcgcgccgcgcgcggtcagctccgtgccgcgcgccgcgcccgccgcgcgcctgccgccggcggcgttcaagcccgccgagctgccggcgcccaggaagcacgccgccgccattgccgcgccggcgccggcctcgccgccgcggacggcggggaggaagaaggagctcaatctcttccagcgcgccgcggcggcggcgctcgacgcgttcgaggaggggttcgtggcgggcgtcctcgagcgcccccacggcctgccccggacggccgacccggccgtgcagatcgccggcaacttcgcgcccgtcggggagaggccccccgcccgcgagctccccgtctccggccgcatcccgcccttcatcaacggcgtgtacgcgcgcaacggcgccaacccctgcttcgaccccgtcgccgggcaccacctcttcgacggcgacggcatggtgcacgcgctgcggatacggaacggcgtcgccgagtcctacgcctgccgcttcaccgagaccgcgcgcctgcgccaggagcgcgcgatcggccgccccgtcttcccaaaggccattggcgagctgcacggccactccgggatcgcgcgccttgctctgttctacgcgcgcgccgcgtgcgggctcgtcgatccctcccacggcaccggcgtcgccaacgccggcctcgtctacttcaacgggcacctcctcgccatgtccgaggacgacctcccgtaccacgtgcgcgtcacggacggcggcgacctcgagaccgtcggcagatacgacttcgacggccagcttgggtgcgccatgatcgcgcacccgaagctcgacccggccaccggcgagctccacgcgctcagctacgacgtcatcaagaagccgtacctcaagtacttctacttcaggcccgacggcaccaagtccgacgacgtcgagatcccgctcgaccagcccaccatgatccacgacttcgccatcaccgagaacttcgtcgtcgtgcccgaccaccaggtggtgttcaagctccaggagatgctgcgcggcggctcgcccgtggtgctggacaaggagaagacgtcgcgcttcggcgtgctccccaagcacgccaaggacgcgtcggagatggcgtgggtggacgtgccggactgcttctgcttccacctgtggaacgcgtgggaggacgaggagaccggcgaggtcgtcgtcatcggctcctgcatgacccccgccgactccatcttcaacgagtccgacgagcacctcgagagcgtgctcacggagatccgcctggacacccgcaccggccggtcctcgcggcgcgccatcctgccgccgtcgcagcaggtgaacctggaggtgggcatggtgaaccgcaacctcctgggccgcaagacccggtacgcgtacctcgccgtggccgagccgtggcccaaggtgtcgggcttcgccaaggtggacctcgccacgggcgagctgaccaagttcgagtacggcgagggccggttcggcggcgagccctgcttcgtgcccatggaccccgccgccgcgcacccgcgcggcgaggacgacgggtacgtgctcaccttcgtgcacgacgagcgcgccggcacgtcggagctcctggtggtcaatgccgtcgacatgcggctggaggccacggtccagctcccgtcccgcgtgcccttcggcttccacggcaccttcatcacggccagcgagctcgaggcccaggcctgatcgcctgagctcccgttcgctccccacctacctccgcgtttcttggagggggcaggagggcgaggaagaacagaggagacacgagccatggatcaggggagaagtcaccagagggagcctcggccatagtaggtccccggagtcttcgccgtccccgacaccacagttacagcagttggtagttaaatttccaatttttttagtttaattaagagtgtattttagttgggatagtggcagattagagaaaggggcccagctcgtagcttttcagctggtgcttgcttctagagagcagccagagctcagctggtgcctactgctagtatagtctacatttttttttggttcccttttttctttggatcagacagggatatgcttccccgctccagctccagttgttgtcactcctcgcagtggactggagtgtccgggatcttggttgccgctgcttgctcgccattgccgcccagttgccgctgaggtgttgctggcatggtttctctatcactgtgtgtacatttgtcgatagtataataaaaactaggaaggtcacccacgcatttgcgcggctagatgttcccatttgt

SEQ ID NO: 362 - protein, 605 aa, Panicum virgatum
  misc_feature (1)..(605): Ceres Clone ID no. 1806409
  misc_feature (1)..(605): Bit score of 1197.7 for HMM based on sequences of Figure 2
  misc_feature (1)..(605): Functional Homolog Of SEQ ID NO. 337
  misc_feature (1)..(605): in Figure 2
  misc_feature (126)..(597): Pfam Name: RPE65 Pfam Description: Retinal pigment epithelial membrane protein
MQGLAPPTSVSIHRRPPAGSRAARGPSSVRFAPRAVSSVPRAAPAARLPPAAFKPAELPAPRKHAAAIAAPAPASPPRTAGRKKELNLFQRAAAAALDAFEEGFVAGVLERPHGLPRTADPAVQIAGNFAPVGERPPARELPVSGRIPPFINGVYARNGANPCFDPVAGHHLFDGDGMVHALRIRNGVAESYACRFTETARLRQERAIGRPVFPKAIGELHGHSGIARLALFYARAACGLVDPSHGTGVANAGLVYFNGHLLAMSEDDLPYHVRVTDGGDLETVGRYDFDGQLGCAMIAHPKLDPATGELHALSYDVIKKPYLKYFYFRPDGTKSDDVEIPLDQPTMIHDFAITENFVVVPDHQVVFKLQEMLRGGSPVVLDKEKTSRFGVLPKHAKDASEMAWVDVPDCFCFHLWNAWEDEETGEVVVIGSCMTPADSIFNESDEHLESVLTEIRLDTRTGRSSRRAILPPSQQVNLEVGMVNRNLLGRKTRYAYLAVAEPWPKVSGFAKVDLATGELTKFEYGEGRFGGEPCFVPMDPAAAHPRGEDDGYVLTFVHDERAGTSELLVVNAVDMRLEATVQLPSRVPFGFHGTFITASELEAQA

SEQ ID NO: 363 - DNA, 1836 bp, Sorghum bicolor
  misc_feature (1)..(1836): Ceres Annot ID no. 8633702
  misc_feature (1)..(1836): Encodes the peptide sequence at SEQ ID NO. 364
atgcagagtctcgccccgcccacctctgtttccatacaccggcagcacctgccggcgtccgggtccagcagggcccgggcctccaattccgtccggttctcgccgcgcgccgtcagctccgtgccgcgcgccaccgcgcccgccgagcgcctccaggcgccgttccacaagcccggcgcggccgacctgccggcgcagtccaagaaacccgccaccgccattgccgtcccgaggcacgccgcggcgccgcggaaggccggcggcaagaagcagctcaacttcttccagcgcgccgcggcggccgcgctcgacgcgttcgaggaagggttcgttgccaacgtcctggagcggccccacgggctgcccagcaccgccgacccggccgtgcagatcgccggcaacttcgcgcccgtcggggagaggccgcccgtgcgcgagctccccgtctccggccgcatcccgcccttcatcaacggcgtctacgcgcgcaacggcgccaacccctgcttcgaccccgtcgccgggcaccacctgttcgacggcgacggcatggtgcacgcgctgcggatacgcaacggcgtcgccgagtcctacgcctgccgcttcacggagaccgcgcgcctcacccaggagcgcgcgatcggacgccccgtcttccccaaggccattggcgagctccacggccactccgggatcgcgcgcctcgccctgttctacgcgcgcgccgcgtgcggcctcgtcgatccctcggcgggaacgggcgtcgctaacgccggcctcgtctacttcaacggccacctcctcgccatgtccgaggacgacctcccctaccacgtccgcgtcgcggacgacggcgacctcgagaccgtcggccgttacgacttcgacggccagctcggctgcgccatgatcgcgcacccgaagctcgacccggtcaccggagagctccacgcgctgagctacgacgtcatcaagaagccgtacctcaagtacttctacttcaggcccgacggcaccaagtccgacgacgtggagatcccgctggaccagcccaccatgatccacgacttcgccatcaccgagaacttcgtggtcgtgcccgaccaccaggtggtgttcaagctccaggagatgctgcgcggcggctcgcccgtggtgctggacaaggagaagacgtcgcgcttcggcgtgctcccgaagcacgcctcggacgcgtcggagatggtgtgggtggacgtgccggactgcttctgcttccacctttggaacgcgtgggaggacgaggcgacgggcgaggtggtggtgatcggctcctgcatgacccccgccgactccatcttcaacgagtccgacgagcgcctcgagagcgtgctcacggagatccgcctggacacgcgcacgggccggtccacgcgccgcgccgtcctgccgccgtcgcagcaggtgaacctggaggtgggcatggtgaaccgcaacctcctgggccgcaagacacggtacgcctacctcgcggtggccgagccgtggcccaaggtgtccggcttcgccaaggtggacctcgaaactggcgagctcaccaagttcgagtacggcgagggccgcttcggcggcgagccctgcttcgtgcccatggacccgtccgcggcgcacccgcgcggcgaggacgacgggtacgtgctcaccttcgtccacgacgagcgcgccggcacgtcggagctcctggtggtcaatgccgccgacatgcggctggaggccacggtccagctcccgtcccgggtgcccttcggcttccacggcaccttcatcacgggcaaggagctcgaggcccaggcctga

SEQ ID NO: 364 - protein, 611 aa, Sorghum bicolor
  misc_feature (1)..(611): Ceres Annot ID no. 8633702
  misc_feature (1)..(611): Bit score of 1217.2 for HMM based on sequences of Figure 2
  misc_feature (1)..(611): Functional Homolog Of SEQ ID NO. 337
  misc_feature (1)..(611): in Figure 2
  misc_feature (132)..(603): Pfam Name: RPE65 Pfam Description: Retinal pigment epithelial membrane protein
MQSLAPPTSVSIHRQHLPASGSSRARASNSVRFSPRAVSSVPRATAPAERLQAPFHKPGAADLPAQSKKPATAIAVPRHAAAPRKAGGKKQLNFFQRAAAAALDAFEEGFVANVLERPHGLPSTADPAVQIAGNFAPVGERPPVRELPVSGRIPPFINGVYARNGANPCFDPVAGHHLFDGDGMVHALRIRNGVAESYACRFTETARLTQERAIGRPVFPKAIGELHGHSGIARLALFYARAACGLVDPSAGTGVANAGLVYFNGHLLAMSEDDLPYHVRVADDGDLETVGRYDFDGQLGCAMIAHPKLDPVTGELHALSYDVIKKPYLKYFYFRPDGTKSDDVEIPLDQPTMIHDFAITENFVVVPDHQVVFKLQEMLRGGSPVVLDKEKTSRFGVLPKHASDASEMVWVDVPDCFCFHLWNAWEDEATGEVVVIGSCMTPADSIFNESDERLESVLTEIRLDTRTGRSTRRAVLPPSQQVNLEVGMVNRNLLGRKTRYAYLAVAEPWPKVSGFAKVDLETGELTKFEYGEGRFGGEPCFVPMDPSAAHPRGEDDGYVLTFVHDERAGTSELLVVNAADMRLEATVQLPSRVPFGFHGTFITGKELEAQA

SEQ ID NO: 365 - protein, 604 aa, Zea mays
  misc_feature (1)..(604): Public GI ID no. 226529341
  misc_feature (1)..(604): Bit score of 1193.0 for HMM based on sequences of Figure 2
  misc_feature (1)..(604): Functional Homolog Of SEQ ID NO. 337
  misc_feature (1)..(604): in Figure 2
  misc_feature (124)..(595): Pfam Name: RPE65 Pfam Description: Retinal pigment epithelial membrane protein
MQGLAPPTSVSIHRHLPARSRARASNSVRFSPRAVSSVPPAECLQAPFHKPVADLPAPSRKPAAIAVPGHAAAPRKAEGGKKQLNLFQRAAAAALDAFEEGFVANVLERPHGLPSTADPAVQIAGNFAPVGERPPVHELPVSGRIPPFIDGVYARNGANPCFDPVAGHHLFDGDGMVHALRIRNGAAESYACRFTETARLRQERAIGRPVFPKAIGELHGHSGIARLALFYARAACGLVDPSAGTGVANAGLVYFNGRLLAMSEDDLPYHVRVADDGDLETVGRYDFDGQLGCAMIAHPKLDPATGELHALSYDVIKRPYLKYFYFRPDGTKSDDVEIPLEQPTMIHDFAITENLVVVPDHQVVFKLQEMLRGGSPVVLDKEKTSRFGVLPKHAADASEMAWVDVPDCFCFHLWNAWEDEATGEVVVIGSCMTPADSIFNESDERLESVLTEIRLDARTGRSTRRAVLPPSQQVNLEVGMVNRNLLGRETRYAYLAVAEPWPKVSGFAKVDLSTGELTKFEYGEGRFGGEPCFVPMDPAAAHPRGEDDGYVLTFVHDERAGTSELLVVNAADMRLEATVQLPSRVPFGFHGTFITGQELEAQAA

SEQ ID NO: 366 - protein, 599 aa, Brachypodium distachyon
  misc_feature (1)..(599): Public GI ID no. 357120366
  misc_feature (1)..(599): Bit score of 1177.4 for HMM based on sequences of Figure 2
  misc_feature (1)..(599): Functional Homolog Of SEQ ID NO. 337
  misc_feature (1)..(599): in Figure 2
  misc_feature (120)..(591): Pfam Name: RPE65 Pfam Description: Retinal pigment epithelial membrane protein
MQTLTTPSSVSIQRHRPRPTGTRAPNLVRFSARAISSGAAARAPAHLSPFVDAPQAKSAIAFPKAPAAGSARRVDEKKKLNFFQRAAAVALDAFEEGFVANVLEKPHGLSRTVDPAVQIAGNFAPVGETPPVQSLPVSGRIPPFINGVYARNGANPHFDPVAGHHLFDGDGMVHALRIRNGVAETYASRFTDTERLRQERALGRPMFPKAIGELHGHSGIARLALFYARSACGLVDPSRGTGVANAGLVYFNGHLLAMSEDDIPYHVRVTEAGDLQTVGRYDFDGQLECPMIAHPKLDPATGQLHALSYDVIKKPYLKYFYFAADGTKSADVEIPLDQPTMIHDFAITENFVVVPDHQVVFKLQEMLRGGSPVVLDKEKTSRFGVLPKCAADASEMVWVDVPDCFCFHLWNAWEEEDTDEVVVIGSCMTPADSIFNESDECLESVLTEIRLNTRTGESTRRPILAPSQQVNLEVGMVNSTLLGRKTRYAYLAVAEPWPKVSGFAKVDLATGELTKFDYGEGRFGGEPCFVPMDPAAASPRGEDDGYILTFVHDERAGTSELLVVNAADMRLEATIQLPSRVPYGFHGTFVKASELESQA

SEQ ID NO: 367 - protein, 515 aa, Glycine max
  misc_feature (1)..(515): Public GI ID no. 356577857
  misc_feature (1)..(515): Bit score of 865.6 for HMM based on sequences of Figure 2
  misc_feature (1)..(515): Functional Homolog Of SEQ ID NO. 337
  misc_feature (43)..(44): Xaa can be any naturally occurring amino acid
  misc_feature (45)..(509): Pfam Name: RPE65 Pfam Description: Retinal pigment epithelial membrane protein
  misc_feature (183)..(189): Xaa can be any naturally occurring amino acid
MAALNSSTWAKPQFHHPLSSSSSLLTDMGFPTRFPKKPIGEVXXAGNFAPVPEHPVQHSLPVIGTIPDAVNGVYLRNGANPLFHPKAGHHLFDGDGMVHAVKINHGTASYACRFTETQRLMQEHALGKPVFPKAIGELHGHSGIARLMLFYARGLCGIVDHRSGAGSANAGLVFFNGKLLAMXXXXXXXELRITASGDLETIGRYSFHDQLNSSMIAHPKVDPISGELFTLSYDVTSKYLKYFRFSPEEEKKSPDVEIPLGAATMTHDFAITENFVVIPDQKVVFKLGEMIKGGSPVIYDDEKKSRFGILPKYASDASSIVWVESPDTFFFHFWNAWEERETDEVVVIGSCMTPPDSIFKDTEESLKSVLTEIRLNIRSGKSTRRVVVEEMNLEAGMVNRNRLGRKTRFAYLCIAEPWPKVSGFAKVDLESGEVKRHEYGERRFGGEPFFLPTRGENGNEDEGYVMAFVHDEVTWQSELQILNALDLKLEATIMLPSRVPYGFHGTFVEAMDLPQ

SEQ ID NO: 368 - protein, 530 aa, Physcomitrella patens
  misc_feature (1)..(530): Public GI ID no. 168065310
  misc_feature (1)..(530): Physcomitrella patens subsp. patens
  misc_feature (1)..(530): Bit score of 732.8 for HMM based on sequences of Figure 2
  misc_feature (1)..(530): Functional Homolog Of SEQ ID NO. 337
  misc_feature (60)..(525): Pfam Name: RPE65 Pfam Description: Retinal pigment epithelial membrane protein
MPSEPSTTRLQPLAPKTRHLNFAQKIADKVIEAVEKNLENLHLGNREPLPSTVDPHVQLEGNFFPVEESPAHHNLEVEGNLPECLEGVYVRNGPNPQFFPTGRHHLFDGDGMLHAVSFNGGSVSYACRYTRTYRFMEEEKHGRAFFPKPIGELHGYGGVAKLMMYWARSLFGILDASQGMGMANAGLVYFNSRLLAISEDDLPVEVRITEDNDIETVGRYDFHGQLTHSMIAHPKIDPHTGELFSLSYNVLSAPYLKYLIFSADGEKKAEVPVALPEAAMTHDFAITENFVVIPDQQIVFRLKEMLTGGSPVVLDPKKTPRFGVMPKYATSEDELKWIGVPDCFFFHLYNAWEEGDEVVVIGSSMTPADIIFKTSEVPRAILTEVRLNRRTGTSTKRELAELNLEVGKMNPQFVGVKTQYMYLAIVEPWPKVSGIAKVDLQSGQVVARHNYGTHRYGGEPVFVPRTSDPSAPEDDGFLLAFCHNEDSGESQLLVLDAATPTLEQVASVSLPSRVPYGFHGAFIPAADLLH

SEQ ID NO: 369 - DNA, 1770 bp, Zea mays
  misc_feature (1)..(1770): Ceres Clone ID no. 258841
  misc_feature (1)..(1770): Encodes the peptide sequence at SEQ ID NO. 370
ctcgcgtcgcacggatctctccttccctccaggctccagctccaaagcctcgtcgccttcttcgccccgccacccgtcctgcacactcacaactagacatcgtaccacccaggtgatctcgcgcgccactccctccttccatcccttagccccagctttactcttccctcccgcgcccagatcccgaggctcctacccctcgatcgccgccttccagcggccgatccggcgctggctcgcggcccccgacaggttttgctttatgctggttcatttgtctacggacaatggactagttgctgcactgtttctgtgattcaccatgggaagcagtggagcagatacaccgtctaaggagcagcagccacctgctacctcaggtgctgcaataccacctgtttatccagattggtctagcttccaggcatatcccccaatcccaccacatggattcttcccctcacctgtggcatcaagtccacagggtcatcctttcatgtggggagctcaagctatgattccaccttatggaacaccgccaccatatgtcatgtacccccctggagtatatgcccacccatctatgcccccgggtgcacatccatttactccttatgccattacttctccaaatggcaatgctgatgctactggaactactgctgcagctggtaatactgatggcaagccctctgaaggcaaagataaaagtccaacaaagcgatccaaaggaagtttgggcagcttgaacatgcttactggaaagaatcccagtgaacatggtaagtcctcaggtgcatcgggtaatggagtcacttctcaaagtggcgaaagtggcagtgacagttcaagcgaagggagtgaaggaaattctcacaatgattcacatcacaaggaaagtggacaggaacacgatggggatgttcgaagttcccggaatggtgtatcacgtttgcaatctgagggaaaattgaaccaagctatggcaatcttgcccataccatcaagtggcccagcaactgatccaactacaaacctaaatattgggatggactattgggccaacacagcaagctctgctcctgcaattcatggcaaagcgacgtcaacaacagttccaggggctgtggtcccagcagagcagtggacacaggatgaacatgaactcaaaaagcaaagaagaaagcagtccaatagggagtctgcacgtagatctaggttacgtaaacaggctgaatgtgaggaattggctcaacgtgctgatgttttaaagcaggaaaatgcttcacttagagatgaagtaaaccgtatcagaaaagagtacgaggaacttctatcaaggaataactcactaaaggaaaaacttgaaggcaaacaacacaaaactgatgaggctggacttaacaacaagctgcaacattctgctgatgacagccagaaaaaaggaaactaatgctatcatgcaatgcttgcctacattggtcctaactagattattgggaggtgcaattgtagtatgcacattaactccttactttattgcagttaattgttaccaggttgtgataatgttgatgccaaccttttgtgtgggtgtttcctgtttcagatctatcttggcttatcttttagaagccaagatgtgactgaagctataggctgtgacccaattcactatatctttagaaatagtggataaagtcaaacttacaaatttgaagtgctgactaatattgttatgtatacctggcaaaagactggttttctttc

SEQ ID NO: 370 - protein, 376 aa, Zea mays
  misc_feature (1)..(376): Ceres Clone ID no. 258841
  misc_feature (1)..(188): Pfam Name: MFMR Pfam Description: G-box binding protein MFMR
  misc_feature (1)..(376): Bit score of 677.9 for HMM based on sequences of Figure 7
  misc_feature (1)..(376): in Figure 7
  misc_feature (279)..(341): Pfam Name: bZIP_1 Pfam Description: bZIP transcription factor
MGSSGADTPSKEQQPPATSGAAIPPVYPDWSSFQAYPPIPPHGFFPSPVASSPQGHPFMWGAQAMIPPYGTPPPYVMYPPGVYAHPSMPPGAHPFTPYAITSPNGNADATGTTAAAGNTDGKPSEGKDKSPTKRSKGSLGSLNMLTGKNPSEHGKSSGASGNGVTSQSGESGSDSSSEGSEGNSHNDSHHKESGQEHDGDVRSSRNGVSRLQSEGKLNQAMAILPIPSSGPATDPTTNLNIGMDYWANTASSAPAIHGKATSTTVPGAVVPAEQWTQDEHELKKQRRKQSNRESARRSRLRKQAECEELAQRADVLKQENASLRDEVNRIRKEYEELLSRNNSLKEKLEGKQHKTDEAGLNNKLQHSADDSQKKGN

SEQ ID NO: 371 - DNA, 1710 bp, Zea mays
  misc_feature (1)..(1710): Ceres Clone ID no. 645403
  misc_feature (1)..(1710): Encodes the peptide sequence at SEQ ID NO. 372
actcgcgtcgcacggatctctccttccctccaggctccagctccaaagcctcgtcgccttcttcgccccgccacccgtcctgcacactcacaactagacatcgtaccacccaggttttgctttatgctggttcatttgtctacggacaatggactagttgctgcactgtttctgtgattcaccatgggaagcagtggagcagatacaccgtctaaggagcagcagccacctgctacctcaggtgctgaaataccacctgtttatccagattggtctagcttccaggcatatcccccaatcccaccacatggattcttcccctcacctgtggcatcaagtccacagggtcatcctttcatgtggggagctcaagatagttgggccatccacctaaagctcaaggaacttgatcctctcaaggggcttggtgagcaggctatgattccaccttatggaacaccgccaccatatgtcatgtacccccctggagtatatgcccacccatctatgcccccgggtgcacatccatttactccttatgccattacttctccaaatggcaatgctgatgctactggaactactgctgcagctggtaatactgatggcaagccctctgaaggcaaagataaaagtccaacaaagcgatccaaaggaagtttgggcagcttgaacatgcttactggaaagaatcccagtgaacatggtaagtcctcaggtgcatcgggtaatggagtcacttctcaaagtggcgaaagtggcagtgacagttcaagcgaagggagtgaaggaaattctcacaatgattcacatcacaaggaaagtggacaggaacacgatggggatgttcgaagttcccggaatggtgtatcacgtttgcaatctgagggaaaattgaaccaagctatggcaatcttgcccataccatcaagtggcccagcaactgatccaactacaaacctaaatattgggatggactattgggccaacacagcaagctctgctcctgcaattcatggcaaagcgacgtcaacaacagttccaggggctgtggtcccagcagagcagtggacacaggatgaacatgaactcaaaaagcaaagaagaaagcagtccaatagggagtctgcacgtagatctaggttacgtaaacaggctgaatgtgaggaattggctcaacgtgctgatgttttaaagcaggaaaatgcttcacttagagatgaagtaaaccgtatcagaaaagagtacgaggaacttctatcaaggaataactcactaaaggaaaaacttgaaggcaaacaacacaaaactgatgaggctggacttaacaacaagctgcaacattctgctgatgacagccagaaaaaaggaaactaatgctatcatgcaatgcttgcctacattggtcctaactagattattgggaggtgcaattgtagtatgcacattaactccttactttattgcagttaattgttaccaggttgtgataatgttgatgccaaccttttgtgtgggtgtttcctgtttcagatctatcttggcttatcttttagaagccaagatgtgactgaagctataggctgtgacccaattcactatatctgttagaaatagtggataaagtcaaacttacaaatttgaagtgctgactaatattgttatgtatacctggcaaaagactggttttcttttaattcagtctggttg

SEQ ID NO: 372 - protein, 397 aa, Zea mays
  misc_feature (1)..(397): Ceres Clone ID no. 645403
  misc_feature (1)..(209): Pfam Name: MFMR Pfam Description: G-box binding protein MFMR
  misc_feature (1)..(397): Bit score of 576.2 for HMM based on sequences of Figure 7
  misc_feature (1)..(397): Functional Homolog Of SEQ ID NO. 370
  misc_feature (300)..(362): Pfam Name: bZIP_1 Pfam Description: bZIP transcription factor
MGSSGADTPSKEQQPPATSGAEIPPVYPDWSSFQAYPPIPPHGFFPSPVASSPQGHPFMWGAQDSWAIHLKLKELDPLKGLGEQAMIPPYGTPPPYVMYPPGVYAHPSMPPGAHPFTPYAITSPNGNADATGTTAAAGNTDGKPSEGKDKSPTKRSKGSLGSLNMLTGKNPSEHGKSSGASGNGVTSQSGESGSDSSSEGSEGNSHNDSHHKESGQEHDGDVRSSRNGVSRLQSEGKLNQAMAILPIPSSGPATDPTTNLNIGMDYWANTASSAPAIHGKATSTTVPGAVVPAEQWTQDEHELKKQRRKQSNRESARRSRLRKQAECEELAQRADVLKQENASLRDEVNRIRKEYEELLSRNNSLKEKLEGKQHKTDEAGLNNKLQHSADDSQKKGN

SEQ ID NO: 373 - DNA, 1158 bp, Sorghum bicolor
  misc_feature (1)..(1158): Ceres Annot ID no. 8717693
  misc_feature (1)..(1158): Encodes the peptide sequence at SEQ ID NO. 374
atgggaagcagtggagcagatacaccgtctaagacaaccaaggcatctgcccctcaggagcagcagccacctgctacctcaggtgctgcaacaccggctgtttatcctgattggtccagcttccaggcatatcctccaatcccaccacatgggttcttcccttcacctgtggcatcaagtccacagggtcatccttacatgtggggagctcagcctatgattccaccatatggaacaccaccgccaccatatgtcatgtaccctcctggagtatatgcccacccatctatgcccccgggtgcacatccatttactccttatgccattacttctccaaatggcaatgctgatgctactggaactactgctgcagctggtgatactgatggcaaaccctctgaaggcaaagataaaagtccaacaaagagatccaaaggaagtttgggcagcttgaacatgcttactggaaagaataccggtgaacatggtaagacctctggtgcatcggctaatggagccacttctcaaagtggcgaaagtggcagtgacagttcaagtgaagggagtgaagaaaattctcataatgattcacatcacaaggaaagtggacaggagcaagatggagatgttcgaagttcccagaatggtgcatcacgttcaccatctgagggaaaattgaaccaagctatgacaatcgtgcccatgccatcaagtggcccagtaactggtccaactacaaacctaaatattggaatggactattgggccaacacagcaagctctgctcctgcaattcatggcaaagtgaccccaacaacagttccaggggctgtggtcccagcagagcaatggatacaggatgaacgtgaactcaaaaggcaaagaagaaagcagtccaatagggagtctgcacgcagatctaggttgcgtaaacaggctgaatgtgaggagttggctcaacgtgcagatgttttaaagcaggaaaatgcttcacttagagatgaagtaaatcgtatcagaaaagagtatgaggaacttctatcaaagaataactcactaaaggaaaagcttgaaggcaaacaacacaaaactgatgaggcaggacttaacaacaagctgcaacattctggcgatgacagccagaaaaaaggaaactaa

SEQ ID NO: 374 - protein, 385 aa, Sorghum bicolor
  misc_feature (1)..(385): Ceres Annot ID no. 8717693
  misc_feature (1)..(197): Pfam Name: MFMR Pfam Description: G-box binding protein MFMR
  misc_feature (1)..(385): Bit score of 716.6 for HMM based on sequences of Figure 7
  misc_feature (1)..(385): Functional Homolog Of SEQ ID NO. 370
  misc_feature (1)..(385): in Figure 7
  misc_feature (288)..(350): Pfam Name: bZIP_1 Pfam Description: bZIP transcription factor
MGSSGADTPSKTTKASAPQEQQPPATSGAATPAVYPDWSSFQAYPPIPPHGFFPSPVASSPQGHPYMWGAQPMIPPYGTPPPPYVMYPPGVYAHPSMPPGAHPFTPYAITSPNGNADATGTTAAAGDTDGKPSEGKDKSPTKRSKGSLGSLNMLTGKNTGEHGKTSGASANGATSQSGESGSDSSSEGSEENSHNDSHHKESGQEQDGDVRSSQNGASRSPSEGKLNQAMTIVPMPSSGPVTGPTTNLNIGMDYWANTASSAPAIHGKVTPTTVPGAVVPAEQWIQDERELKRQRRKQSNRESARRSRLRKQAECEELAQRADVLKQENASLRDEVNRIRKEYEELLSKNNSLKEKLEGKQHKTDEAGLNNKLQHSGDDSQKKGN

SEQ ID NO: 375 - protein, 382 aa, Zea mays
  misc_feature (1)..(382): Public GI ID no. 212721672
  misc_feature (1)..(195): Pfam Name: MFMR Pfam Description: G-box binding protein MFMR
  misc_feature (1)..(382): Bit score of 674.9 for HMM based on sequences of Figure 7
  misc_feature (1)..(382): Functional Homolog Of SEQ ID NO. 370
  misc_feature (285)..(347): Pfam Name: bZIP_1 Pfam Description: bZIP transcription factor
MGSSGADTSSKPNKASAPQEQQQPATSGAATPAVYPDWSSFQAYPPIPPHGFFPSPVASSPQGHPYMWGAQPMIPPYGAPPYVMYPPGVYAHPSMASGAHPFTPYAITSPNGNADATGTTAVACDTDGKPSEGKDKSPTKRPKGTLGSLNMLTGKNPSEHGKTSGASANGATSQSGESGSDSSSEGSEGNSHNDSYKHSGQEQDGDVRSSQNGASRSPSEGKFNQAMAIMPMPSSGPVTGPTTNLNIGMDYWANTASSAPVIHGKVTPTTVPGAVVPAEQWIQDERELKRQKRKQSNRESARRSRLRKQAECEELAQRADVLKQENASLRDEVNRIRKEYEELLSKNNSLKEKLEGKQHKTDEAGLNNKLQHSGNDIQKKGN

SEQ ID NO: 376 - protein, 390 aa, Oryza sativa
  misc_feature (1)..(390): Public GI ID no. 115487934
  misc_feature (1)..(390): Oryza sativa Japonica Group
  misc_feature (1)..(202): Pfam Name: MFMR Pfam Description: G-box binding protein MFMR
  misc_feature (1)..(390): Bit score of 714.0 for HMM based on sequences of Figure 7
  misc_feature (1)..(390): Functional Homolog Of SEQ ID NO. 370
  misc_feature (1)..(390): in Figure 7
  misc_feature (293)..(355): Pfam Name: bZIP_1 Pfam Description: bZIP transcription factor
MGSSGADAPTKTSKASAPQEQQPPASSSTATPAVYPDWANFQGYPPIPPHGFFPSPVASSPQGHPYMWGAQPMIPPYGTPPPPYVMYPPGVYAHPSMPPGAHPFTPYAMASPNGNADPTGTTTTAAAAAAGETDGKSSEGKEKSPIKRSKGSLGSLNMITGKNSTEHGKTSGASANGAISQSGESGSESSSEGSEANSQNDSHHKESGQEQDGEVRSSQNGVSRSPSQAKLNQTMAIMPMTSSGPVPAPTTNLNIGMDYWANTASSTPAIHGKATPTAAPGSMVPGEQWVQDERELKRQRRKQSNRESARRSRLRKQAECEELAQRAEVLKQENTSLRDEVNRIRKEYDELLSKNSSLKEKLEDKQHKTDEAGVDNKLQHSGDDSQKKGN

SEQ ID NO: 377 - protein, 381 aa, Brachypodium distachyon
  misc_feature (1)..(381): Public GI ID no. 357160384
  misc_feature (1)..(192): Pfam Name: MFMR Pfam Description: G-box binding protein MFMR
  misc_feature (1)..(381): Bit score of 680.1 for HMM based on sequences of Figure 7
  misc_feature (1)..(381): Functional Homolog Of SEQ ID NO. 370
  misc_feature (1)..(381): in Figure 7
  misc_feature (283)..(345): Pfam Name: bZIP_1 Pfam Description: bZIP transcription factor
MGSSGADTPTKEQQPPATSSAATPVVYPDWTNFQGYPPIPPHGFFPSPVVSSPQGHPYMWGAQPMMQPYGTPPYVMYPPGGIYAHPSMPPGAHPFAPYAMASANGNADATGTATAAAPSAGETDGKSSEGKEKSPIKSSKGSLGSLNMITGKNCVEHGKTSGASANGAISQSGESGSESSSEGSEPNSQNDSHHKESGQEQDGEIRSSQNGVSRSPSQAKLKQTMAIMPMPSSGSMPGPTTNLNIGMDYWANTASSPPAAHGKATPTAVPGTAVPTEPWMQDERELKRQRRKQSNRDSARRSRLRKQAECEELAQRAEVLKQENATLRDEVNRVRKEYDELISKNNSLKDKLGDKEHKTDDAELDNKPQRSGDDSQKKETN

SEQ ID NO: 378 - protein, 388 aa, Triticum aestivum
  misc_feature (1)..(388): Public GI ID no. 208431904
  misc_feature (1)..(200): Pfam Name: MFMR Pfam Description: G-box binding protein MFMR
  misc_feature (1)..(388): Bit score of 695.9 for HMM based on sequences of Figure 7
  misc_feature (1)..(388): Functional Homolog Of SEQ ID NO. 370
  misc_feature (1)..(388): in Figure 7
  misc_feature (291)..(353): Pfam Name: bZIP_1 Pfam Description: bZIP transcription factor
MGSSEAETPAKANKASAPQEQQPPATSSTATPTVYPDWTSFQGYPPIPPHGFFPSPVVSNPQGHPYMWGPQPMMPPYGTPPYVIYPPGGIYAHPSMRPGAHPFAPYTMTSPNGNPDAAGTTITAATAGGETNGKSSEGKEKSPIKRSKGSLGSLNMITGKNCVEHGKTSGASANGTISQSGESGSESSSEGSEANSQNDSQHKESGQEQDGDVRSSQNGVSPSPSQAQLKQTLAIMQMPSSGPVPGPTTNLNIGMDYWANTASSSPALHGKVTPTAIPGAVAPTEPWMQDERELKRQKRKQSNRDSARRSRLRKQAECEELAQRAEVLKQENASLKDEVSRIRKEYDELLSKNSSLKDNVGDKQHKTDEAGLDNKLQHSGDDSQKDTN

SEQ ID NO: 379 - protein, 387 aa, Hordeum vulgare
  misc_feature (1)..(387): Public GI ID no. 326531522
  misc_feature (1)..(387): Hordeum vulgare subsp. vulgare
  misc_feature (1)..(198): Pfam Name: MFMR Pfam Description: G-box binding protein MFMR
  misc_feature (1)..(387): Bit score of 663.8 for HMM based on sequences of Figure 7
  misc_feature (1)..(387): Functional Homolog Of SEQ ID NO. 370
  misc_feature (290)..(352): Pfam Name: bZIP_1 Pfam Description: bZIP transcription factor
MRSSEAETPAKANKASTPQEQQPPTSSTTTPTVYPDWTNFQGYPPIPPHGFFPSPVVSNPQGHPYMWGPQPMMPPYGTPPYVIYPPGGVYAHPSMRPGAHPFAPYAMSSSNGNPDATGTTTTPATAGGETNGKSSDGIEKSPIKRSKGSLGSLNMITGKNCVEHGKTSGASANGTISQSGESGSESSSEGSEANSQNDLQHKESGQEQDGDVRSSQNGVSPSPSQAQLKQTSAIMQMPSSGPVPGPTTNLKIGMDYWANTASSSPALHGKVTPTAIPGDLAPTEPWMQDERELKRQKRKQSNRDSARRSRLRKQAECEELAQRAEVLKQENASLKDEVSRIRKEYDELLSKNSSLKDNIGDKQHKTDEAGLHNKLQRSGDDNQKDTN

SEQ ID NO: 380 - DNA, 1811 bp, Panicum virgatum
  misc_feature (1)..(1811): Ceres Clone ID no. 1910316
  misc_feature (1)..(1811): Encodes the peptide sequence at SEQ ID NO. 381
actccactccgccagtcgcgagccgcagcccgcagctccgcgtcgcgtcgcatcgcacgcatcccccctccctcgtcgtcttcctcgcccccgcccccgccccgcgcccccagctagacacaccgtaccgccaggtttttgctttatgctggttcatgtgtccacagacaatggactaattgctgacctgtctctgtgattcaccatgggaagcagtggagctgatacaccgtctaagacaagcaaggcgtctgccccacaggaacaacagccacctgctacctcaggtgctgcaacaccggctgtttactcagattggtccagcttccaggcatatcctccaatcccaccacatgggttcttcccttcacctgtggcatcaagtccacagggtcatccttacatgtggggagctcaaatctgaaccaagagtactagtgcgcaactgatatgtgatactttggaagcctatgatcccaccatatggaacaccgccaccgccatatgtcatgtaccctcctggagtatatgctcacccgtctatgcccccgggtgcacatccattcactacttatgctatgacttctccaaatggctatgctgatgctactggaactactgcagcagctggtgatactgacaggaagccctctgaaggcaaagacaaaagtccaacaaaaagatccaaaggtagtttaggtagcttgaacatgcttactgggaagaatcctaccgaacatggtaagacctcaggagcatcagctaatggagccacttctcaaagtggggaaagcggtagtgaaagttcaagtgaagggagcgaaggaaattctcagaatgattcacatcacaaggaaagtggacaggaacaggatggagatgttcgaagttcccagaatggtgcatcacgctcaccatctgagggaaaattgaaccagactatggcaatcatgccaatgccatcaagtggcccagtacctggtccaactacaaacctcaatatagggatggattattgggccaacacagcaagctccgctcctgcaattcatggcaaagtgaccccgacaacagttacaggtgctgtggtcccaaccgagcagtggatacaggggagatctcgtagttcttggtctgctatacgtttcctggcagcagaggatgaacgcgaactcaaaaggcaaagaaggaagcagtccaacagggagtcggcacgcagatctaggttgcgtaaacaggctgagtgtgaagagttagctcaacatgctgatgttttaaagcaggaaaatgcttcacttagagatgaagttaaccgtatcagaaaagagtacgaggagcttctatcaaagaataactcactaaaggaaaaactcgaaggcaaacagcacaaaactgatgaggcaggacttaacaagctgcaacattctggcgatgatagccagaaaaagggaaactaattgagctcttatgcaatgctcgcatggcatggccctaactagattattgggaggcgcaattgtagtatgcgtattaactccttactttattgcagttaattgttaccaggttgtgataatgttaatgccaaccttgtgtgtgggtggttcctgtttcagatctatcttggcttatcttttagaagtcaagatgtgactgaagacgtaggttgtgacccagttcactgtatctgttagaaatagtggataaactcaaatttacaaatttgtattgctgactagtactgttatgtatacctggcaaaagactggtttcttttagttcaatcaggttgaactttttgctgggctttc

SEQ ID NO: 381 - protein, 328 aa, Panicum virgatum
  misc_feature (1)..(328): Ceres Clone ID no. 1910316
  misc_feature (1)..(125): Pfam Name: MFMR Pfam Description: G-box binding protein MFMR
  misc_feature (1)..(328): Bit score of 527.4 for HMM based on sequences of Figure 7
  misc_feature (1)..(328): Functional Homolog Of SEQ ID NO. 370
  misc_feature (232)..(294): Pfam Name: bZIP_1 Pfam Description: bZIP transcription factor
MIPPYGTPPPPYVMYPPGVYAHPSMPPGAHPFTTYAMTSPNGYADATGTTAAAGDTDRKPSEGKDKSPTKRSKGSLGSLNMLTGKNPTEHGKTSGASANGATSQSGESGSESSSEGSEGNSQNDSHHKESGQEQDGDVRSSQNGASRSPSEGKLNQTMAIMPMPSSGPVPGPTTNLNIGMDYWANTASSAPAIHGKVTPTTVTGAVVPTEQWIQGRSRSSWSAIRFLAAEDERELKRQRRKQSNRESARRSRLRKQAECEELAQHADVLKQENASLRDEVNRIRKEYEELLSKNNSLKEKLEGKQHKTDEAGLNKLQHSGDDSQKKGN

SEQ ID NO: 382 - protein, 367 aa, Hordeum vulgare
  misc_feature (1)..(367): Public GI ID no. 27469354
  misc_feature (1)..(367): Hordeum vulgare subsp. vulgare
  misc_feature (1)..(178): Pfam Name: MFMR Pfam Description: G-box binding protein MFMR
  misc_feature (1)..(367): Bit score of 575.6 for HMM based on sequences of Figure 7
  misc_feature (1)..(367): Functional Homolog Of SEQ ID NO. 370
  misc_feature (270)..(332): Pfam Name: bZIP_1 Pfam Description: bZIP transcription factor
MRSSEAETPAKANKASTPQEQQPPTSSTTTPTVYPDWTNFQGYPPIPPHGFFPSPVVSNPQGHPYMWGPQPMMPPYGTPPYVIYPPGGVYAHPSMRPGTTTTPATAGGETNGKSSDGIEKSPIKRSKGSLGSLNMITGKNCVEHGKTSGASANGTISQSGESGSESSSEGSEANSQNDLQHKESGQEQDGDVRSSQNGVSPSPSQAQLKQTSAIMQMPSSGPVPGPTTNLKIGMDYWANTASSSPALHGKVTPTAIPGDLAPTEPWMQDERELKRQKRKQSNRDSARRSRLRKQAECEELAQRAEVLKQENASLKDEVSRIRKEYDELLSKNSSLKDNIGDKQHKTDEAGLHNKLQRSGDDNQKDTN

SEQ ID NO: 383 - protein, 390 aa, Oryza sativa
  misc_feature (1)..(311): Public GI ID no. 125536186
  misc_feature (1)..(311): Oryza sativa Indica Group
  misc_feature (1)..(202): Pfam Name: MFMR Pfam Description: G-box binding protein MFMR
  misc_feature (1)..(311): Bit score of 711 for HMM based on sequences of Figure 7
  misc_feature (1)..(311): Functional Homolog Of SEQ ID NO. 370
  misc_feature (293)..(355): Pfam Name: bZIP_1 Pfam Description: bZIP transcription factor
MGSSGADAPTKTSKASAPQEQQPPASSSTATPAVYPDWANFQGYPPIPPHGFFPSPVASSPQGHPYMWGAQPMIPPYGTPPPPYVMYPPGVYAHPSMPPGAHPFTPYAMASPNGNADPTGTTTTAAAAAGGETGGKSSEGKEKSPIKRSKGSLGSLNMITGKNSTEHGKTSGASANGAISQSGESGSESSSEGSEANSQNDSHHKESGQEQDGEVRSSQNGVSRSPSQAKLNQTMAIMPMTSSGPVPAPTTNLNIGMDYWANTASSTPAIHGKATPTAAPGSMVPGEQWVQDERELKRQRRKQSNRESARRSRLRKQAECEELAQRAEVLKQENASLRDEVNRIRKEYDELLSKNSSLKEKLEDKQHKTDEAGVDNKLQHSGDDSQKKGN

SEQ ID NO: 384 - protein, 405 aa, Ricinus communis
  misc_feature (1)..(405): Public GI ID no. 255555917
  misc_feature (1)..(195): Pfam Name: MFMR Pfam Description: G-box binding protein MFMR
  misc_feature (1)..(405): Bit score of 755.4 for HMM based on sequences of Figure 7
  misc_feature (1)..(405): Functional Homolog Of SEQ ID NO. 370
  misc_feature (1)..(405): in Figure 7
  misc_feature (301)..(363): Pfam Name: bZIP_1 Pfam Description: bZIP transcription factor
MGSSDMDKTAKEKESKTQPPTTTQEQSSATTTGTVNPDWTGFQAYSPIPPHGFVASSPQAHPYMWGVQPIMPPYGTPPHPYVAMYPHSGIYAHPSIPPGSYPFSPFAMPSPNGIAEASGYTPGNTEPDGKPSDVKEKLPIKRSKGSLGSLNMITGKNNELGKTSGASANGAYSKSAESGSEGTSEGSDANSQNDSQMKSGGRQDSEDASQNGGSAHGLQNGGQANTVMNQTMSIVPISATGAPGALPGPATNLNIGMDYWGATSSAIPAIRGKVPSTPVAGGVVTPGSRDAVQSQLWLQDERELKRQRRKQSNRESARRSRLRKQAECDELAQRAEALKEENANLRSEVNRIKSEYEQLLAENASLKERLGEIPGNDDLRASRNDQHLSNDTQKTEQTEIVQAGH

SEQ ID NO: 385 - protein, 400 aa, Populus trichocarpa
  misc_feature (1)..(400): Public GI ID no. 224074359
  misc_feature (1)..(194): Pfam Name: MFMR Pfam Description: G-box binding protein MFMR
  misc_feature (1)..(400): Bit score of 740.6 for HMM based on sequences of Figure 7
  misc_feature (1)..(400): Functional Homolog Of SEQ ID NO. 370
  misc_feature (1)..(400): in Figure 7
  misc_feature (303)..(365): Pfam Name: bZIP_1 Pfam Description: bZIP transcription factor
MGSSDMDKTGKEKEAKTPSAASTQEQPSTAGAATVNPDWSGFQAYSHIPPPGFLASSPQAHPYMWGVQHIMPPYGTPPHPYVAMYPHGVYAHPSIPPGSYPFSPFAMPSPNGIAEVSGNTPGSMEAEGRPSDAKEKLPIKRSKGSLGSLNMITGKNNEHGRTTGASANGAYSKSAESGSEGTSEGSDADSQSDSQMKSGGRQDSLEETSQNGGSAHAAQNGGQGASTIMNQTMGVLPISAASAPGVIPGPTTNLNIGMDYWGAPVASSVPAIRGKVPSTPVAGGIATAGSRDGVQSQHWLQDERELKRQRRKQSNRESARRSRLRKQAECDELAQRAEVLKEENANLRSEVNRIKSEYEQLLAENASLKERLGEVHGQEDSRAGRNDQHTSNDTQQTGQT

SEQ ID NO: 386 - protein, 413 aa, Vitis vinifera
  misc_feature (1)..(413): Public GI ID no. 147845138
  misc_feature (1)..(194): Pfam Name: MFMR Pfam Description: G-box binding protein MFMR
  misc_feature (1)..(413): Bit score of 764.2 for HMM based on sequences of Figure 7
  misc_feature (1)..(413): Functional Homolog Of SEQ ID NO. 370
  misc_feature (1)..(413): in Figure 7
  misc_feature (305)..(367): Pfam Name: bZIP_1 Pfam Description: bZIP transcription factor
MGSSEMDKAGKEKESKTPPTTTQEQSSTTSAGTVNPDWSGFQAYSPIPPHGFLASSPQAHPYMWGVQHLMPPYGTPPHPYVAMYPPGGLYAHPSIPPGSYPFSPFAMPSPNGIAETSGTTPGSMEADGKSSEGKEKLPIKRSKGSLGSLNMLTGKNNELGKTSGASANGVYSKSAESASEGSSEGSDANSQSDSQLKSGCRQDSLEAETSQNGSTCHAPQNGGPNTPHAMVNQTMAIMPISAPGAPGGVPGPTTNLNIGMDYWGAPTSSTIPAMRGKVPSAPVTGGIVTAGSRDSVQSQLWLQDERELKRQRRKQSNRESARRSRLRKQAECDELAQRADALKEENASLRAEVNRIKSEYEQLLSENASLKERLGEIPGQDDHRTGGRNEQHSGNDTKQTGQTGQAEHGQGGH

SEQ ID NO: 387 - protein, 401 aa, Populus trichocarpa
  misc_feature (1)..(401): Public GI ID no. 224139026
  misc_feature (1)..(194): Pfam Name: MFMR Pfam Description: G-box binding protein MFMR
  misc_feature (1)..(401): Bit score of 728.9 for HMM based on sequences of Figure 7
  misc_feature (1)..(401): Functional Homolog Of SEQ ID NO. 370
  misc_feature (304)..(366): Pfam Name: bZIP_1 Pfam Description: bZIP transcription factor
MVSSDMDKTGKEKEAKPPSAAPTQEQPSTASATTVNPDWSGFQAYSPIPPPGFLASSPQAHPYMWGVQHIMPPYGTPPHPYVAMYPHGVYAHPSIPPGSYPFSPFAMPSPNGIAEASGNTPGSMEADGRPSDAKEKLPIKRSKGSLGSLNMITGKNNEHGKTTGVSANGAYSKSAESGSEGSSEGSDANSQSDSQMKSGGRQDSLEDSSQNGGSAHGAQNGGQGASNTIMNQTMAIMPISAASAPGAIPGPTTNLNIGMDYWGAPASSTVPAIRGKVPSTPVAGGVVSTGSRDGVQSQIWLQDERELKRQRRKQSNRESARRSRLRKQAECDELAQRAEALKEENANLRSEVNQIKSEYEQLLAENASLKERLGEVSGQEDFRAGRNDQHMSNDTQQTGQT

SEQ ID NO: 388 - protein, 413 aa, Vitis vinifera
  misc_feature (1)..(413): Public GI ID no. 225427091
  misc_feature (1)..(194): Pfam Name: MFMR Pfam Description: G-box binding protein MFMR
  misc_feature (1)..(413): Bit score of 762.0 for HMM based on sequences of Figure 7
  misc_feature (1)..(413): Functional Homolog Of SEQ ID NO. 370
  misc_feature (305)..(367): Pfam Name: bZIP_1 Pfam Description: bZIP transcription factor
MGSSEMDKAGKEKESKTPPTTTQEQSSTTSAGTVNPDWSGFQAYSPIPPHGFLASSPQAHPYMWGVQHLMPPYGTPPHPYVAMYPPGGLYAHPSIPPGSYPFSPFAMPSPNGIAETSGTTPGSMEADGKSSEGKEKLPIKRSKGSLGSLNMLTGKNNELGKTSGASANGVYSKSAESASEGSSEGSDANSQSDSQLKSGCRQDSLEAETSQNGSTCHAPQNGGPNTPHAMVNQTMAIMPISAPGAPGGVPGPTTNLNIGMDYWGAPTSSTIPAMRGKVPSAPVTGGIVTAGSRDSVQSQLWLQDERELKRQRRKQSNRESARRSRLRKQAECDELAQRADALKEENASLRAEVSRIKSEYEQLLSENASLKERLGEIPGQDDHRTGGRNEQHLGNDTKQTGQTGQAEHGQGGH

SEQ ID NO: 389 - DNA, 1155 bp, Populus trichocarpa
  misc_feature (1)..(1155): Ceres Annot ID no. 1538994
  misc_feature (1)..(1155): Encodes the peptide sequence at SEQ ID NO. 390
atggttagcagtgatatggataaaactgggaaggaaaaggaggccaagccaccatctgctgctcctacacaggagcagccttcaactgccagtgctacaactgtaaatccagactggtctgggtttcaggcatattctcctatacctccacctgggttcttggcatcaagtccccaagctcacccgtatatgtggggggttcagcacatcatgcctccctatggtaccccaccacatccatatgtggcaatgtatccgcatggtgtatatgctcatccatccattcctccgggttcttatccttttagtccttttgcaatgccttctccaaatggtattgctgaggcttctggaaacactcctggcagcatggaagcagatggtaggccatctgatgctaaggaaaaactgccaattaaaagatcgaaaggaagtttgggcagtttaaacatgatcactgggaagaacaatgagcatggtaaaacaacaggagtgtctgccaacggagcttattctaagagtgctgagagtggtagtgaaggctccagtgaaggaagtgatgcaaattctcagagtgactcacaaatgaagtcaggtggcaggcaagattctctggaagcacatggtgctcagaatggaggacagggtgcatctaatacgatcatgaatcaaacgatggctatcatgccaatatctgctgccagtgctccaggagctatacctggccccacaaccaacttaaatattggaatggactactggggagcccctgcttcatctactgttcctgcaattcgtgggaaagttccttctactccagttgctggaggggtagtttctactggatcacgggatggtgttcaatcgcagatttggttacaggatgaaagagagcttaagagacagagaaggaagcagtcaaacagagaatccgctcgccggtccaggttgcgtaaacaggctgaatgtgatgaactggcccaacgtgctgaagccttaaaagaagaaaatgccaatcttagatcagaagtaaaccaaatcaagagcgagtatgagcaacttcttgcggagaacgcctctctcaaggaagattttagggctggcaggaatgaccaacatatgagcaatgatacacaacagactggacaaacatag

SEQ ID NO: 390 - protein, 379 aa, Populus trichocarpa
  misc_feature (1)..(379): Ceres Annot ID no. 1538994
  misc_feature (1)..(379): Bit score of 677.1 for HMM based on sequences of Figure 7
  misc_feature (1)..(379): Functional Homolog Of SEQ ID NO. 370
  misc_feature (5)..(189): Pfam Name: MFMR Pfam Description: G-box binding protein MFMR
  misc_feature (291)..(353): Pfam Name: bZIP_1 Pfam Description: bZIP transcription factor
MDKTGKEKEAKPPSAAPTQEQPSTASATTVNPDWSGFQAYSPIPPPGFLASSPQAHPYMWGVQHIMPPYGTPPHPYVAMYPHGVYAHPSIPPGSYPFSPFAMPSPNGIAEASGNTPGSMEADGRPSDAKEKLPIKRSKGSLGSLNMITGKNNEHGKTTGVSANGAYSKSAESGSEGSSEGSDANSQSDSQMKSGGRQDSLEAHGAQNGGQGASNTIMNQTMAIMPISAASAPGAIPGPTTNLNIGMDYWGAPASSTVPAIRGKVPSTPVAGGVVSTGSRDGVQSQIWLQDERELKRQRRKQSNRESARRSRLRKQAECDELAQRAEALKEENANLRSEVNQIKSEYEQLLAENASLKEDFRAGRNDQHMSNDTQQTGQT

SEQ ID NO: 391 - protein, 414 aa, Glycine max
  misc_feature (1)..(414): Public GI ID no. 356531457
  misc_feature (1)..(197): Pfam Name: MFMR Pfam Description: G-box binding protein MFMR
  misc_feature (1)..(414): Bit score of 757.7 for HMM based on sequences of Figure 7
  misc_feature (1)..(414): Functional Homolog Of SEQ ID NO. 370
  misc_feature (1)..(414): in Figure 7
  misc_feature (308)..(370): Pfam Name: bZIP_1 Pfam Description: bZIP transcription factor
MGSSEMDKTTKEKESKTPPPPTSQEQSSTTGTGTINPEWPGFQAYSPIPPHGFLASSPQAHPYMWGVQQFMPPYGTPPHPYVAMYPPGGIYAHPSMPPGSYPFNPFAMPSPNGIAEASGNTPGSMEADGKPSEVKEKLPIKRSKGSLGSLNMITGKNNEHGKTLGTSANGIHSKSGESASEGEGTSEGSDANSQNDSQLKSGGRQDSFEDEPSQNGSSAYTPQNGGLNIPHTVVNQTMSIIPISAGGAPGAVPGPTTNLNIGMDYWGTPGSSNIPGLGRKVPSTAVAGGMVTVGSRDSAQSQLWLQDERELKRQRRKQSNRESARRSRLRKQAECDELAQRAEALKEENASLRSEVNRIRSDYEQLLSENAALKERLGELPPNDDHHHRSGRNDQHVGNDTQQSGQTEAVQGGH

SEQ ID NO: 392 - protein, 397 aa, Phaseolus vulgaris
  misc_feature (1)..(397): Public GI ID no. 13775109
  misc_feature (1)..(196): Pfam Name: MFMR Pfam Description: G-box binding protein MFMR
  misc_feature (1)..(397): Bit score of 734.4 for HMM based on sequences of Figure 7
  misc_feature (1)..(397): Functional Homolog Of SEQ ID NO. 370
  misc_feature (1)..(397): in Figure 7
  misc_feature (301)..(363): Pfam Name: bZIP_1 Pfam Description: bZIP transcription factor
MGSSEMDKTPKEKESKTPPPTSQEQSSTTATGTINPDWPGFQAYSPIPPHGFLASSPQAHPYMWGVQQFMPPYGTPPHPYVAMYPPGGIYAHPSMPPGSYPFSPFAMPSPNGIAEASGNTPGSMEADGKPPEVKEKLPIKRSKGSLGSLNMITGKNNEHGKTRGTSANGIHSKSGDSASEGEGTSEGSDANSQNDSQMKSGGRQDSFEDEPSQNGTSAYTSQNGGISTPATVVNQNVPIIPISAGGAPGAVPGPTTNLNIGMDYWGTPAPSNIPALGRKVPSTAVAGSRDSVQSQLWLQDEREIKRQRRKQSNRESARRSRLRKQAECDELAQRAEALKEENASLRSEVSRIRSDYEQLLSENTALKERLGELPANDQHVGNEAQQNGQTEGVQGGH

SEQ ID NO: 393 - DNA, 1254 bp, Populus trichocarpa
  misc_feature (1)..(1254): Ceres Annot ID no. 1447080
  misc_feature (1)..(1254): Encodes the peptide sequence at SEQ ID NO. 394
atgggtagcagtgatatggataaaacaggaaaggagaaggaggccaagacaccatctgctgcttctacacaggaacagccttcaactgccggtgctgccactgtaaatccagactggtctgggtttcaggcctattctcatatacctccaccagggttcttggcatcaagtccccaagctcacccatatatgtggggggttcagcacattatgcctccctatggtaccccaccacatccatatgttgcaatgtatcctcacggtgtatatgctcatccgtccattcccccgggttcttatccttttagtccttttgcaatgccttctccaaatggtatcgctgaggtttctggaaacactcctggcagcatggaagccgaaggaagaccatctgatgccaaggaaaaattacctattaaaaggtccaaaggaagcttgggcagtttaaacatgattactgggaagaataatgagcatgggagaacaacaggagcatctgctaatggagcttattcgaaaagtgctgagagtggaagtgaaggcacaagtgaaggaagtgatgcggattctcagagtgactcacaaatgaagtcaggtggcagacaagattctctggaagaaacatctcagaatggtggttctgcacatgctgctcagaatggaggacagggtgcatctacaatcatgaatcaaacaatgggtgtcctgccaatatctgctgccagtgcccctggagttatacctggtcccacaaccaacttaaatattggaatggactattggggagcccctgttgcttctagtgttcctgcaattcgtgggaaggttccttctactccagttgctggagggattgctactgctggatcacgggatggtgttcaatcgcagcattggttacaggatgaaagagagcttaagagacagagaaggaagcagtcaaacagagaatctgctcgccggtccaggttgcgtaaacagctacgtgctcctatatcaattcattggcttgcatgcatgcttttgagtcaggctgaatgcgatgagctggcccaacgtgctgaagttttaaaagaagaaaatgccaatcttagatcagaagtaaatcggatcaagagcgagtatgagcagcttcttgcagagaacgcctctctcaaggagaggctcggggaagttcatggacaagaagattccagggctggcaggaatgaccaacatacgagcaatgatacacaacagactggacaaacatag

SEQ ID NO: 394 - protein, 412 aa, Populus trichocarpa
  misc_feature (1)..(412): Ceres Annot ID no. 1447080
  misc_feature (1)..(412): Bit score of 592.7 for HMM based on sequences of Figure 7
  misc_feature (1)..(412): Functional Homolog Of SEQ ID NO. 370
  misc_feature (6)..(189): Pfam Name: MFMR Pfam Description: G-box binding protein MFMR
  misc_feature (339)..(377): Pfam Name: bZIP_1 Pfam Description: bZIP transcription factor
MDKTGKEKEAKTPSAASTQEQPSTAGAATVNPDWSGFQAYSHIPPPGFLASSPQAHPYMWGVQHIMPPYGTPPHPYVAMYPHGVYAHPSIPPGSYPFSPFAMPSPNGIAEVSGNTPGSMEAEGRPSDAKEKLPIKRSKGSLGSLNMITGKNNEHGRTTGASANGAYSKSAESGSEGTSEGSDADSQSDSQMKSGGRQDSLEETSQNGGSAHAAQNGGQGASTIMNQTMGVLPISAASAPGVIPGPTTNLNIGMDYWGAPVASSVPAIRGKVPSTPVAGGIATAGSRDGVQSQHWLQDERELKRQRRKQSNRESARRSRLRKQLRAPISIHWLACMLLSQAECDELAQRAEVLKEENANLRSEVNRIKSEYEQLLAENASLKERLGEVHGQEDSRAGRNDQHTSNDTQQTGQT

SEQ ID NO: 395 - protein, 414 aa, Glycine max
  misc_feature (1)..(414): Public GI ID no. 356496180
  misc_feature (1)..(198): Pfam Name: MFMR Pfam Description: G-box binding protein MFMR
  misc_feature (1)..(414): Bit score of 751.3 for HMM based on sequences of Figure 7
  misc_feature (1)..(414): Functional Homolog Of SEQ ID NO. 370
  misc_feature (309)..(371): Pfam Name: bZIP_1 Pfam Description: bZIP transcription factor
MGSSEMDKTPKEKESKTPPPPPTSQEQSSTTSTGTINPEWPGFQAYSPIPPHGFLASNPQAHPYMWGVQQFMPPYGTPPHPYVAMYPPGGIYAHPSMPPGSYPFSPFAMPSPNGIAEASGNTPGSMEADGKPPEVKEKLPIKRSKGSLGSLNMITGKNNEHGKTPGTSANGIHSKSGESASEGEGTSEGSDANSQNDSQLKSGGRQDSFEDEPSQNGSLAYTAQNGGLNTPHTVVNQTMSIIPISAGGAPGAVPGPTTNLNIGMDYWGTPASSNIPALGRKVPSTAVAGGMVTVGSRDSAQSQLWLQDERELKRQRRKQSNRESARRSRLRKQAECDELAQRAEALKEENASLRSEVNRIRSDYEQLVSENSALKERLGELPANDDHHRSCRNDQHVGNDTQQSGQTEAMPGGQ

SEQ ID NO: 396 - protein, 394 aa, Catharanthus roseus
  misc_feature (1)..(394): Public GI ID no. 5381313
  misc_feature (1)..(196): Pfam Name: MFMR Pfam Description: G-box binding protein MFMR
  misc_feature (1)..(394): Bit score of 638.5 for HMM based on sequences of Figure 7
  misc_feature (1)..(394): Functional Homolog Of SEQ ID NO. 370
  misc_feature (296)..(358): Pfam Name: bZIP_1 Pfam Description: bZIP transcription factor
MGSSEIDKSSKEAKEAKEAKETPPSSQEQPAATSAGTPDWTGFQAYSPIPPHGFLASSPQAHPYMWGVQHLMPPYGTPPHPYVAMYPHGGIYAHPSIPPGSYPFSPFAMPSPNGIAEPSVNTPGNMEVDGKASEGKEKLPIKRSRGSLGSLNMITGKNNDAGKTSGASANGACSKSAESASEGSSEGSDANSQNESQMKSGNRQDSGETSQNGSGAHGSQNGGTNTPHSMVAMVPLSASGGVTGPATNLNIGMDYWGTAASPTVPVVRGKVPSTPVGGGMVPARDPVQAQLWIQDERELKRQRRKQSNRESARRSRLRKQAECDELAQRAEALKEENNSLRAEVSLIRSEYEQLLAQNAALKERLGEASGQDDPRSSRNEQQHSVQRETAARSQ

SEQ ID NO: 397 - protein, 420 aa, Petroselinum crispum
  misc_feature (1)..(420): Public GI ID no. 3336906
  misc_feature (1)..(208): Pfam Name: MFMR Pfam Description: G-box binding protein MFMR
  misc_feature (1)..(420): Bit score of 624.2 for HMM based on sequences of Figure 7
  misc_feature (1)..(420): Functional Homolog Of SEQ ID NO. 370
  misc_feature (316)..(378): Pfam Name: bZIP_1 Pfam Description: bZIP transcription factor
MGSSGMDKSPKDIKEAKEPKIPTSQEQPSPAAAAAAAAAAAAAAGPVTPDWSGFQAYSPMPPHGYMASSPQAPHPYMWGVQHMMPPYGTPPHPYVMYPHGGIYAHPSMPPGSYPFSPFAIPSPNGVAEAFGNTPGSTEADGKVSEGKEKLPIKRSKGSLGSLNMITGKNNEASKTLGAAANGGYSKSGDSASDGSSEEGSDANSQNDSQIKSGSRQDSLEGESQNGNAHGLQNGQNANHSMVNQQISIVPITAAGTAGAIPGPMTNLNIGMDYWGGVTSSAVPAMRGKVTSPPITGGIVTAGARDNVQSQLWLQDERELKRQRRKQSNRESARRSRLRKQAECDELAQRAEVLQEENASLRAELGRARSEYEKALAQNAILKEKVGDVAGQEDQWPGRNDQHTGDEGQETGHIEPGQSGH

SEQ ID NO: 398 - DNA, 1976 bp, Glycine max
  misc_feature (1)..(1976): Ceres Clone ID no. 1611686
  misc_feature (1)..(1976): Encodes the peptide sequence at SEQ ID NO. 399
ggccaatcaccccttacataaaaaacaaaatttgggagcacagcggcaaggggagtaaacgagctttccactttgattctttccgaaatcgaagctgtaacgaaatctctgccacgggacagcgacaccgtacgaccttcccattgtttcctcaacgtgaacaatacaacaccacaccaccacccactaacaatacctaaagcctaacgaaccctaattcttgatcattgctcaattctttgttcccttcccatctcggagacacgaattcgccttcttcctcatttcccaaacaaatttcccctccgcactcccccaatttattctttttttcgcattttattttacccttttgaacctgtggcttcttttcgacgccccccatgtatcagaatggattagtgtaaattattggaaggtacctatataaaagcatgggcagtagtgacatggacaaaaccccgaaagaggagtctaagacacctccagctacgtcacaggagcagtcatcaacaactggcatgccaacaactaatcctgactggtctaactttcagacgtattctcctatacctccacatgggttcttggcatcaagcccccaagcccacccatatatgtggggcgtccagcatattatgcctccctatggcactccacctcatccctatgttgcaatgtatccccatggtggcatatatgctcatccatccattcctccgggatcttatcctttcagtccttttgccatggcttctccaaatggtattgcagatgcttcaggaaatgccccaggtagcatcgaagttggtggtaaacctcctgaaatgaaggaaaaattacctatcaaaagatcaaaaggaagtgttagtggtggtaatttgagcatgtggattactgggaaaaataatgaacctggtaaaacaccaggagaatctgctaatgggattcattccaaaagtggtgaaagtgcaagtgacggaactagtgaaggaagtgatgagaactcccagaatgactctcaattgaaatccggggagaagcaggactcttttgaagatgaaccatctcaaaatggcagtccagtacatgctcctcaaaatggggtacataatagatctcagacagttgttaatcaaactatgcctatcttacctatatcttccacaagtgctagtggagcagttcctggtcccacaactaatttaaatataggaatggattattggggcacaccaacttcatccaccattcctgcactgcatggaaaggttccttctgctgcagttgctggagggatgattgctgctggatcacgagatggcgttcagccacaagtttggctgcaggacgaaagagagcttaaaagacaaagacggaaacagtctaatcgggagtctgcacgcagatccaggttacggaagcaggccgaatgtgatgaactagctcagcgtgctgaagctttgaaagaagaaaatgccagtctccgatcagaagtgagccggatcaggagtgagtatgagcagctacgttctgagaatgctgccctcaaggatagacttggggagatacctggtgtcacgacacctgggaaggaggatcttaggtctggccagaatgatcagcatgtgagtaatgacactcaacaaagtggtcagacagatgttgtgcatggtgttcattaggatcttgcttcctgctgcatgttgctttttaggaagataacctaaccatgtagcaacagcaagttctagtttttggatagctttggttcaaattgtattaaaggtgatcatatgtagtattaggatctatttatgtcatatgatccctcattcctaatttgtcatgtttatgatggcaaaaaacttgtattgtaggtagggtgtgaatacttacttggtcataccttctctgctacttcgtaagttagtgttagcagcaagaagtatgattaccgaaattagttattgtcc

SEQ ID NO: 399 - protein, 416 aa, Glycine max
  misc_feature (1)..(416): Ceres Clone ID no. 1611686
  misc_feature (1)..(196): Pfam Name: MFMR Pfam Description: G-box binding protein MFMR
  misc_feature (1)..(416): Bit score of 683.0 for HMM based on sequences of Figure 7
  misc_feature (1)..(416): Functional Homolog Of SEQ ID NO. 370
  misc_feature (307)..(369): Pfam Name: bZIP_1 Pfam Description: bZIP transcription factor
MGSSDMDKTPKEESKTPPATSQEQSSTTGMPTTNPDWSNFQTYSPIPPHGFLASSPQAHPYMWGVQHIMPPYGTPPHPYVAMYPHGGIYAHPSIPPGSYPFSPFAMASPNGIADASGNAPGSIEVGGKPPEMKEKLPIKRSKGSVSGGNLSMWITGKNNEPGKTPGESANGIHSKSGESASDGTSEGSDENSQNDSQLKSGEKQDSFEDEPSQNGSPVHAPQNGVHNRSQTVVNQTMPILPISSTSASGAVPGPTTNLNIGMDYWGTPTSSTIPALHGKVPSAAVAGGMIAAGSRDGVQPQVWLQDERELKRQRRKQSNRESARRSRLRKQAECDELAQRAEALKEENASLRSEVSRIRSEYEQLRSENAALKDRLGEIPGVTTPGKEDLRSGQNDQHVSNDTQQSGQTDVVHGVH

SEQ ID NO: 400 - DNA, 1748 bp, Gossypium hirsutum
  misc_feature (1)..(1748): Ceres Clone ID no. 1927515
  misc_feature (1)..(1748): Encodes the peptide sequence at SEQ ID NO. 401
tctcccaatcgtgccctaattattttccctcaaattgacatctgtgcctttctcccccacccatcttaattcaatttcaacctccttagcttccgaaattttgcatctattcagtggatcaggcttgggtttcatttcaatttggtttgttcttcgagtggatggtttgaggggcttttagaagttggttgctggatatagagaatgggcagcagtgagatggataaagctgcaaaagagaaggagccaaagacgccgcctgctattaccacgcaggagccgtcatcgaccactaactcgggttcagtaaatgccgattggtctgggtttcaggcatattctcccattcctccacatgggttcttggcgtcaagtccccaagctcccccatatatgtggggagttcagcatattatgcctccatatggtaccccaccacatccttatgttgcaatgtatcctcacggtggaatatatgctcatccatcccttcctccaggatcttatccttttagtccttttgctatgccttctcctaatggcattgctgaggcttctggaaatactcccgggagcatggaaatggatggcaaacctcctgaagtgaaagaaaagttgccaattaaaagatcaaaagggagtttaggcagtttgaacatgattaccggaaagaacaataatcttggtaaaacatcaggagcttctgctaatggaggttactctaaaagtgctgacagtggaagtgaaggtacaagcgaaggcagtgatgcaaactcccagaacgattcgcaattgcagtctggagacggaaaagattctggagaaggtgaagcatctcagaacggacgctcagctcatggtcctcagaatggaggtcctaattcagcccattcagtggcaaatacagcactggccattgtacctatatcaactactggggctgccacagctgttcctggtccaactactaacttacatattgggatggactactggggaacacctgcttcatctaatgttcctgcaatgcatgcgaaggttccttcaaccccagttgcaggaggaattgtaacccctggatcacgggacaatgtccagtctcagctttggttacaggatgaaagagagcttaaaagacagagaaggaagcaatcaaacagagagtctgctcggcgatcaaggttgcgtaagcaggcggaatgtgatgagctggctcaacgtgctgaagccttaaaggaagaaaatgctaaccttagatcagaagttagtcgtctcaagagcgagtatgagcagcttcatgctgagaatgcctctctcaaggagaggctaggggaaatccctgggcacgaggatctgaagtctggtaggaatgaccaacatagaaatgaagatgaagaaacagagagtgtgcagggtagtcactaggtttcatataccctgtttcgtgcctcatccaggagcacaacctaaccaaattagctacagaaggtttttattttgcatagcatgtttaaattttatcaaagctgaccttgatagtttttaggcccctttatccccttataatccatcaccagtgatttggcttgtctttacaatgaaagtcttaggatgttatgtagggtcaatatcctgtcatacctttccctattgaaagaagggtacagtttaacttttcaagcttgttttatgttaaaatatgattgatgaatgttttaactgtgggaagtaatgaactctgattcgtt

SEQ ID NO: 401 - protein, 406 aa, Gossypium hirsutum
  misc_feature (1)..(406): Ceres Clone ID no. 1927515
  misc_feature (1)..(195): Pfam Name: MFMR Pfam Description: G-box binding protein MFMR
  misc_feature (1)..(406): Bit score of 681.1 for HMM based on sequences of Figure 7
  misc_feature (1)..(406): Functional Homolog Of SEQ ID NO. 370
  misc_feature (306)..(368): Pfam Name: bZIP_1 Pfam Description: bZIP transcription factor
MGSSEMDKAAKEKEPKTPPAITTQEPSSTTNSGSVNADWSGFQAYSPIPPHGFLASSPQAPPYMWGVQHIMPPYGTPPHPYVAMYPHGGIYAHPSLPPGSYPFSPFAMPSPNGIAEASGNTPGSMEMDGKPPEVKEKLPIKRSKGSLGSLNMITGKNNNLGKTSGASANGGYSKSADSGSEGTSEGSDANSQNDSQLQSGDGKDSGEGEASQNGRSAHGPQNGGPNSAHSVANTALAIVPISTTGAATAVPGPTTNLHIGMDYWGTPASSNVPAMHAKVPSTPVAGGIVTPGSRDNVQSQLWLQDERELKRQRRKQSNRESARRSRLRKQAECDELAQRAEALKEENANLRSEVSRLKSEYEQLHAENASLKERLGEIPGHEDLKSGRNDQHRNEDEETESVQGSH

SEQ ID NO: 402 - DNA, 1164 bp, Arabidopsis thaliana
  misc_feature (1)..(1164): Ceres Annot ID no. 834509
  misc_feature (1)..(1164): Encodes the peptide sequence at SEQ ID NO. 403
atgggtagcagtgagatggaaaaatcaggtaaagagaaagaacctaagactacaccgccttcgacttcttcatctgctcctgctactgttgtttcacaggaaccttcttctgctgtgagtgctggagtggctgttactcaagattggtctggcttccaggcttattctcctatgccgcctcatggttatgtagcatcaagtcctcaacctcatccttatatgtggggcgttcagcatatgatgccgccttatggaacaccgcctcatccgtatgttacgatgtatcctccaggtggcatgtatgctcatccttcattacctccggggtcttatccatatagtccctatgcaatgccttctcctaatggaatggctgaagcttctggtaatactggaagtgttattgagggtgatggtaaaccatctgatgggaaggaaaaattgccaatcaaaagatcaaaaggaagcttgggaagtttgaatatgattataggaaagaacaatgaagctggaaaaaactcaggagcatcagctaatggagcttgttctaaaagtgctgagagcggttctgatggatcaagtgacggaagtgatgcaaattcacaaaacgactctggctctagacacaacgggaaggatggtgaaacagcttcagagagtggtggttctgctcatggaccaccccgtaatggaagtaatctaccagtgaaccagaccgtcgctatcatgccagtgtcggctacaggtgttccaggcccaccaacaaatctaaatatcggaatggattattggagcggtcatgggaatgtttctggagcagttcctggagttgtagtagatggttcccaatcacagccatggttacaggatgagagagagattaagcgacagagacggaagcaatccaatagggaatctgctcgtagatccaggttgcgtaaacaggcggagtgtgatgagctagcacaacgagcagaggttttgaatggagagaactcaagtcttagagcagaaattaacaagcttaaaagccaatatgaagagcttcttgctgaaaatagctctctcaagaataagttctcgtcagccccgtcactggaaggtggagacttggacaagaacgagcaagaaccacagagaagtacacgtcaggatgttgcgtag

SEQ ID NO: 403 - protein, 387 aa, Arabidopsis thaliana
  misc_feature (1)..(387): Ceres Annot ID no. 834509
  misc_feature (1)..(205): Pfam Name: MFMR Pfam Description: G-box binding protein MFMR
  misc_feature (1)..(387): Bit score of 546.8 for HMM based on sequences of Figure 7
  misc_feature (1)..(387): Functional Homolog Of SEQ ID NO. 370
  misc_feature (291)..(353): Pfam Name: bZIP_1 Pfam Description: bZIP transcription factor
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 404 - DNA, 355 bp, Arabidopsis thaliana
  misc_feature (1)..(355): Ceres Promoter PD3317
caaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

What is claimed is:

1. A method of increasing plant yield in a plant grown under drought stress, osmotic stress, or nitrogen deficiency, said method comprising:
   (a) growing plants transformed with an exogenous nucleic acid under drought stress, osmotic stress, or nitrogen deficiency, said exogenous nucleic acid comprising a heterologous promoter operably linked to a nucleotide sequence encoding a polypeptide having at least 95% amino acid sequence identity to the amino acid sequence as set forth in SEQ ID NO: 2; and
   (b) selecting a transformed plant from said transformed plants that expresses said polypeptide and has increased yield when grown under drought stress, osmotic stress, or nitrogen deficiency as compared to the corresponding yield of a control plant of the same species that does not comprise said exogenous nucleic acid and grown under identical stress conditions.

2. The method according to claim 1, wherein growing said transformed plants is under drought stress, and said drought stress is selected from the group consisting of pre-flowering drought stress and post-flowering drought stress.

3. The method according to claim 2, wherein growing said transformed plants is under osmotic stress, and said osmotic stress is selected from the group consisting of a soil electric conductivity between 4 dS/m and 5 dS/m, and a soil conductivity between 6 dS/m and 7 dS/m.

4. The method according to claim 1, wherein growing said transformed plants is under nitrogen deficiency, and said nitrogen deficiency is selected from the group consisting of a 50 Kg per hectare nitrogen application, and a 75 Kg per hectare nitrogen application.

5. The method according to claim 1, further comprising harvesting biomass from said selected transformed plant.

6. The method according to claim 1, wherein said polypeptide has at least 97% amino acid sequence identity to the amino acid sequence as set forth in SEQ ID NO: 2.

7. A method of producing a plant with tolerance to drought stress, osmotic stress, or nitrogen deficiency, said method comprising:
   (a) expressing in a plurality of plants transformed with an exogenous nucleic acid comprising a nucleotide sequence encoding a polypeptide, said exogenous nucleic acid comprising a heterologous promoter operably linked to the nucleotide sequence, and the polypeptide having at least 95% amino acid sequence identity to the amino acid sequence as set forth in SEQ ID NO: 2;
   (b) selecting from said plurality of transformed plants a transformed plant that expresses said polypeptide and has increased tolerance to drought stress, osmotic stress, or nitrogen deficiency as compared to a control plant of the same species lacking said exogenous nucleic acid and grown under identical stress conditions; and
   (c) growing the selected transformed plant having increased tolerance to drought stress, osmotic stress, or nitrogen deficiency as compared to a control plant of the same species lacking said exogenous nucleic acid and grown under identical stress conditions.

8. The method according to claim 7, wherein said selected transformed plant has said increased tolerance to drought stress, and said drought stress is selected from the group consisting of pre-flowering drought stress and post-flowering drought stress.

9. The method according to claim 7, wherein said selected transformed plant has said increased tolerance to osmotic stress, and said osmotic stress is selected from the group consisting of a soil electric conductivity between 4 dS/m and 5 dS/m, and a soil conductivity between 6 dS/m and 7 dS/m.

10. The method according to claim 7, wherein said selected transformed plant has said increased tolerance to nitrogen deficiency stress, and said nitrogen deficiency stress is selected from the group consisting of a 50 Kg per hectare nitrogen application, and a 75 Kg per hectare nitrogen application.

11. The method according to claim 7, wherein the polypeptide has 97% or greater amino acid sequence identity to the amino acid sequence as set forth in SEQ ID NO: 2.

12. The method according to claim 1 or claim 7, wherein said exogenous nucleic acid has 95% or greater nucleotide sequence identity to the nucleotide sequence of SEQ ID NO: 1.

13. The method according to claim 1 or claim 7, wherein said plant is selected from the group consisting of *Panicum virgatum*, *Sorghum bicolor*, *Miscanthus giganteus*, *Saccha-* rum sp., *Populus balsamifera*, *Zea mays*, *Glycine max*, *Brassica napus*, *Triticum aestivum*, *Gossypium hirsutum*, *Oryza sativa*, *Helianthus annuus*, *Medicago sativa*, *Beta vulgaris*, and *Pennisetum glaucum*.

14. A method of producing a transgenic plant with increased yield grown under drought stress, osmotic stress, or nitrogen deficiency stress, said method comprising:
    (a) growing plant cells transformed with an exogenous nucleic acid, wherein said exogenous nucleic acid comprising a polynucleotide having a nucleotide sequence encoding a polypeptide having at least 95% amino acid sequence identity to the amino acid sequence of SEQ ID NO: 2, and wherein said nucleotide sequence is operably linked to a heterologous promoter;
    (b) producing transgenic plants from said transformed plant cells; and
    (c) selecting for a transgenic plant from said transgenic plants that expresses said polypeptide in the selected transgenic plant and which exhibits increased yield when grown under drought stress, osmotic stress, or nitrogen deficiency stress as compared to a control plant of the same plant species that does not comprise said exogenous nucleic acid and grown under identical stress conditions.

15. The method of claim 14, wherein said polypeptide has at least 97% amino acid sequence identity to the amino acid sequence of SEQ ID NO: 2.

* * * * *